United States Patent 7,955,604 (NUCLEIC ACIDS AND PROTEINS FROM STREPTOCOCCUS GROUPS A AND B) - sequence listing, part 3

SEQ ID NO: 8963 - DNA, 4734 bp, Streptococcus agalactiae
atgttacaagaaaaggagatttttatgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 8964 - protein, 1570 aa, Streptococcus agalactiae
MNTKQRFSIRKYKLGAVSVLLGTLFFLGGITNVAADSVINKPSDIAVEQQVKDSPTSIANETPTNNTSSALASTAQDNLVTKANNSPTETQPVAESHSQATETFSPVANQPVESTQEVSKTPLTKQNLAVKSTPAISKETPQNIDSNKIITVPKVWNTGYKGEGTVVAIIDSGLDINHDALQLNDSTKAKYQNEQQMNAAKAKAGINYGKWYNNKVIFGHNYVDVNTELKEVKSTSHGMHVTSIATANPSKKDTNELIYGVAPEAQVMFMRVFSDEKRGTGPALYVKAIEDAVKLGADSINLSLGGANGSLVNADDRLIKALEMARLAGVSVVIAAGNDGTFGSGASKPSALYPDYGLVGSPSTAREAISVASYNNTTLVNKVFNIIGLENNRNLNNGLAAYADPKVSDKTFEVGKQYDYVFVGKGNDNDYKDKTLNGKIALIERGDITFTKKVVNAINHGAVGAIIFNNKAGEANLTMSLDPEASAIPAIFTQKEFGDVLAKNNYKIVFNNIKNKQANPNAGVLSDFSSWGLTADGQLKPDLSAPGGSIYAAINDNEYDMMSGTSMASPHVAGATALVKQYLLKEHPELKKGDIERTVKYLLMSTAKAHLNKDTGAYTSPRQQGAGIIDVAAAVQTGLYLTGGENNYGSVTLGNIKDKISFDVTVHNINKVAKDLHYTTYLNTDQVKDGFVTLAPQQLGTFTGKTIRIEPGQTQTITIDIDVSKYHDMLKKVMPNGYFLEGYVRFTDPVDGGEVLSIPYVGFKGEFQNLEVLEKSIYKLVANKEKGFYFQPKQTNEVPGSEDYTALMTTSSEPIYSTDGTSPIQLKALGSYKSIDGKWILQLDQKGQPHLAISPNDDQNQDAVAVKGVFLRNFNNLRAKVYRADDVNLQKPLWVSAPQAGDKNYYSGNTENPKSTFLYDTEWKGTTTDGIPLEDGKYKYVLTYYSDVPGSKPQQMVFDITLDRQAPTLTTATYDKDRRIFKARPAVEHGESGIFREQVFYLKKDKDGHYNSVLRQQGEDGILVEDNKVFIKQEKDGSFILPKEVNDFSHVYYTVEDYAGNLVSAKLEDLINIGNKNGLVNVKVFSPELNSNVDIDFSYSVKDDKGNIIKKQHHGKDLNLLKLPFGTYTFDLFLYDEERANLISPKSVTVTISEKDSLKDVLFKVNLLKKAALLVEFDKLLPKGATVQLVTKTNTVVDLPKATYSPTDYGKNIPVGDYRLNVTLPSGYSTLENLDDLLVSVKEDQVNLTKLTLINKAPLINALAEQTDIITQPVFYNAGTHLKNNYLANLEKAQTLIKNRVEQTSIDNAIAALRESRQALNGKETDTSLLAKAILAETEIKGNYQFVNASPLSQSTYINQVQLAKNLLQKPNVTQSEVDKALENLDIAKNQLNGHETDYSGLHHMIIKANVLKQTSSKYQNASQFAKENYNNLIKKAELLLSNRQATQAQVEELLNQIKATEQELDGRDRVSSAENYSQSLNDNDSLNTTPINPPNQPQALIFKKGMTKESEVAQKRVLGVTSQTDNQKVKTNKLPKTGESTPKITYTILLFSLSMLGLATIKLKSIKRE

SEQ ID NO: 8965 - DNA, 741 bp, Streptococcus agalactiae; identical to SEQ ID NO: 6307

SEQ ID NO: 8966 - protein, 247 aa, Streptococcus agalactiae
LNKSWLRKGGIKMVCVDFIDQKVYSEAEGLFVSDLDLGIKGLIRARYPFALDSDFISYGNLSHYCMNYLDEIVQRANQKNEKIKYNVTTLMKEEEKPFNVEERLNKQATIGQRIADDVARFGGSWTFIIVFVSIMAIWMLVNIMKPFGIQFDPYPFILLNLALSTIAAIQAPLIMMSQNRAADYDRLQARNDFNVNKTSELEIRLLHEKIDHMVQQDQFELLEIQKLQTEMLVSLGNQLAQLKQLQK

SEQ ID NO: 8967 - DNA, 636 bp, Streptococcus agalactiae
atgaatcttttaattatgggtttgcctggtgctggtaaaggtactcaagcagctaagatcgttgaagaatttggtgttgctcacatctcaacaggggatatgttccgcgccgcaatggctaatcaaaccgaaatgggacgtttagctaaaagttatattgataaaggtgaattggttcctgatgaagtaacaaacgggattgtaaaagagcgcttagctgaggatgatatcgcagaaaaaggttttttacttgatggatatccacgtactattgaacaagcacacgccttagatgctacgcttgaagaactaggactacgcttagatggtgttattaatattaaagtggatccatcatgtcttatagagcgtttgagtgktcgtattatcaatcgtaaaactggtgaaactttccacaaagtgttcaacccaccagtagattataaagaagaagattactatcaacgtgaagatgataagcctgaaactgtcaaacgtcgcttggacgttaatattgctcaaggagaacctattcttgaacactatcgtaagcttggtcttgttacagatattgaaggtaatcaagaaataacagaagtttttgcagatgttgaaaaagcgttgctagaactcaaa

SEQ ID NO: 8968 - protein, 212 aa, Streptococcus agalactiae
  MISC_FEATURE (1)..(212): Xaa = Any Amino Acid
MNLLIMGLPGAGKGTQAAKIVEEFGVAHISTGDMFRAAMANQTEMGRLAKSYIDKGELVPDEVTNGIVKERLAEDDIAEKGFLLDGYPRTIEQAHALDATLEELGLRLDGVINIKVDPSCLIERLSXRIINRKTGETFHKVFNPPVDYKEEDYYQREDDKPETVKRRLDVNIAQGEPILEHYRKLGLVTDIEGNQEITEVFADVEKALLELK

SEQ ID NO: 8969 - DNA, 1302 bp, Streptococcus agalactiae
atgtttttaaaattacttagagatgcactcaaagtaaagatggtaagaaataaaattttatttactatctttatccttcttgtatttcgtatcggaacgcatatcacagtaccgggcatcaatgttaagagtttagaacaaatgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctawacttttgkacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaa

SEQ ID NO: 8970 - protein, 434 aa, Streptococcus agalactiae
  MISC_FEATURE (1)..(434): Xaa = Any Amino Acid
MFLKLLRDALKVKMVRNKILFTIFILLVFRIGTHITVPGINVKSLEQMGELPFLNMLNLVSGNAMRNFSVFSMGVSPYITASIVVQLLQMDILPKFVEWGKQGEVGRRKLNQATRYISLFLAFVQSIGITAGFNTLSSVALVKTPNVQTYLLIGAILTTGSMVVTWLGEQITDKGFGNGVSMIIFAGIISSIPSAITTIYEDFFVNVRSSAITNSYIFVGILIVAVLAIVFFTTFIQQAEYKIPIQYTKLVQGAPTSSYLPLKVNPAGVIPVIFASSITTIPSTIIPFFQNGKEIPWLTKLQELLNYQTPVGMIIYAILIILFSFFXTFXQVNPEKTAENLQKNSSYIPSIRPGRETEEYMSSLLKKLATIGSVFLAFISLLPIIAQQALHLSSSIALGGTSLLILIATGIEGMKQLEGYLLKRRYVGFMNTTE

SEQ ID NO: 8971 - DNA, 1278 bp, Streptococcus agalactiae; identical to SEQ ID NO: 6413

SEQ ID NO: 8972 - protein, 426 aa, Streptococcus agalactiae
VRYSKEIIQLAIPAMIENILQMLMGVVDNYLVAQLGVVAVSGVSVANNIITIYQAIFIALGASIASLLAKSLAGSKKDDAISVCSQAIFLTLLIGAVLGIISIVFGQTFFKLLGTTKSVAQVGGLYLAIVGGGVVTLGMLTTLGSFLRVQGQPRLPMYVSIFVNFLNAVLSGFAIFEWRYGLVGVAVSTLIARLIGICILAKYLPIKKIIKRMTWKISAQIWNLALPSAGERLMMRAGDVVIVAIVVQLGTNVVAGNAIGETLTQFNYMPGLGIATATIILTAKYVGQKNRESIEETIQSSYYIGLVLMILISSFMLLAGKPLTQLFTNNPSAIKGSLIVILLSFVGVPATIGTLVYTAAWQGLGNAKLPFYTTTIGMWLIRVVLGYLLGIVFELGLLGVWMATIADNIFRWLFLKVHYHRYIQKM

SEQ ID NO: 8973 - DNA, 1125 bp, Streptococcus agalactiae
atgaaacattatcaaaccataattatcggtgcaggcgctgcaggaatcggttttggttctgccatgcaacgattaggacttacaaattttcttatcattgaaaaagggcacattggagaatcttttttaagatggcccagaacaacacaatttatcacaccttcyttcactacmaatggctttggttttccagatctaaacgctgttattccagatacttctcctgctttctcatttgaaaaagaacatctttctggagtggaatatgcacgctacttacaattagttgctgctcattataatctccctatccaaaacgaaacatctgttctatctattgataaacgagatagcctttttgttattaaaacttcaaagggagatttttctgctgattatcttattatggcaacaggagaatttcaaaatccaaataccattgatattaaaggtgcagatctaggaatgcactatggtcaagttgataatttccatatcaaatctgacaatccatttatcatcattggtggaaacgaaagtgcttgtgatgcactaacacatctagtatatttgggaaatcaagtcgaattatatacagatacgtttggtcgtaaagagagcaatcccgatccaagcatctctttatcccccctaactaaagaacgtttaaaacatatacaagaccacaaaaaagaatattatagtatctctgaaggcaagaaagccattgagattaaacaaattggaaaacaatatcaagttacttttgatgacggtagtactgcggagtctttccataaacctattctttccacaggttttctaaatacctgtcatctcattgacggaatcgctttatttgaatacgataaaaatcagttgccaatagttactgaagatgacgaatctactatcgttaataactgtttcttaattggtccaagcttacgacaaagagatactattttctgctatatttataaattcagacagcgctttgtccctgttattaatcatatcgcacaacgagaagggattatattagacgaagatacccttgaattctttaaagaaaatcaaatgtaccttgataacctagcttgttgcgatgtcaattgtgattgc

SEQ ID NO: 8974 - protein, 375 aa, Streptococcus agalactiae; identical to SEQ ID NO: 6456

SEQ ID NO: 8975 - DNA, 1041 bp, Streptococcus agalactiae
gtgtttgtaaagaaaggactatttgtgtttttactattatgtattttatcgatgtggctcatgatttttggggttgcattctattactttgggtcgctacatcaatcattgacttcaaggattatttatcagtttgtacttactgttttgctaacgacaacagcttggttcatgggtgcctattttttagcatttgaaggtcattttaaaactgtctttcaattccaagaagcagatggtaaacaaattgtaaattgtttatttcaactttgtttcgccctttacgcagtagtaatgcttattgggtcaattattgatagagttcagacgaagcgacttttattagctgttgtttcttggcttttcttggtgtatacgcccttagcttatttaatttggaattcagagggtgtttttgcaaagatgggagtacttgatttttcaggcggaatgatcgttcatttatctgcagggctttcttcgtatattttagctcatgttattggcaagagtgaacatcagcacaataaggttaaaaatgatagtctctttttaggaatgatacttattacatttggttggtttggatttaatatgggtccagttggtgagtggaattcacaagccattatgatacttttaaatactatatttgctattataggtggtggtttggcgtggacattggctgctaagtggaatggtgaggaagagaaaacaggaagcttattgaatggcattattgttggtcttgtgacgagtacagcaggagttgggtatctcttaacttggcaattattagctgtaacattctttgcatccctcttcacctactttgtaacggattacgwwgcgaaagcttttgccattgatgatgtcgtttcctcctttggaatgaatggtattgggggattgttgggaagtttaggagttggtctctttaaattatcacatatgccagttcaactgttagcattagctaccacaattcttttgtcaattataatgacctatatcatatctaaagcgatttttagaaaa

SEQ ID NO: 8976 - protein, 347 aa, Streptococcus agalactiae
  MISC_FEATURE (1)..(347): Xaa = Any Amino Acid
VFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYXAKAFAIDDVVSSFGMNGIGGLLGSLGVGLFKLSHMPVQLLALATTILLSIIMTYIISKAIFRK

SEQ ID NO: 8977 - DNA, 939 bp, Streptococcus agalactiae
gtgaaaaatatgatgaaatatatatcagagttaacaaccctgattgcgttagctggtttaatggttattatcacactcattaatcctaatttcctcacaaccaataatctactcaatttattattacaagtaactgcaaatggttttatcgctttcgggatgaccttcgttattttgactggcggtattgatttatcagtcgggtccatattagccctatctagtgcattaacagctggattaatcggccacggagtacccgttggtattgctatcgttttatctgttgccttaggtggcatcttgggaatgctaaacggactcttcatttcttacggaaaattagcaccatttatcgttacactggcaacaatgactatctttagaggagcaacgctagtttattcaaacggcaacccaattaccgctggcttatccgatagttttctattccaatttttgggacaaggctatattgttggtatcccattcccagtcattctcatgtttcttacttttattattttgtatattttgttacataaaacagccttcgggaaatctgtttacgctttaggaggtaatgaaaaagcagcgtatatctcgggtattaagttaaacaaagttaaaattatcatctacactatctcaggtatcatggcttccatttctgggttaattatcacatcacgccttagctcagcacaaccaacagctggagcaagttatgagatggatgctattgccgccgttgtcttaggtggaacgtctttatctggtgggaaaggacgtatcattggaacattgattggtgctcttattattggtgtcctgaacaatggattaaacatcattggtgtctctgcattttggcaacaagttgtgaaaggtatcgttattttaatggctgttttacttgatcgctttaaagtagcaaaa

SEQ ID NO: 8978 - protein, 313 aa, Streptococcus agalactiae
VKNMMKYISELTTLIALAGLMVIITLINPNFLTTNNLLNLLLQVTANGFIAFGMTFVILTGGIDLSVGSILALSSALTAGLIGHGVPVGIAIVLSVALGGILGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 8979 - DNA, 1086 bp, Streptococcus agalactiae
atgtcacatgcttggaaagaattaaccttttataagaaaaaatacctcctgattgaattgctaatcattgttatgatgttcatggtagtttttttatcaggtttagcaaacggtttaggtagagctgttagtgctgctattgaaaataacccagctcaaacctatattttgaatgaaggtgctgaacaagtgattacatcatctgtattgacaactaaagatcagacagatttaaacagtttgaatttaaaagatagtaccactttaaatattcaacgttcgagtttaactcgacaaggacacgaaaagaaaattgatatttcttattttgctattgataaagattcttttatggcacctacactttctgagggaaaacaactgacaagttacaaaaaagctattattttaaatgatagtttaaaagctgaagggataaagttaggtgataaagtgattgataagtcatcatctatatcactaacagtcgttggatttgtccataatagtatgtatggtcacggacctgtggcatttattgataaagacatttataccgaaattaataaaaagattaatcctcaataccagttcttacctcaggcattagttatgaaaaatgataaaagtatatctcatttaccaactcaattagaagctgttagtaaaaaagatgtcattcaacatattcctggttatagtgccgaacaatccactttgaatatgattttatgggtccttgtcgtagcttcagctggtattttaggtgtctttttctacatcatcacacttcaaaaacgtcatgaatttagcgtcatgaaagctattgggacaaaaatgtcagagattgccctatttcaattgagtcaagtcattatattggcactgtttggtatcattgttggagatggattggcggttgctctctcttatgtattaccagctcaaatgccatttgttattaattggcaaaatattattctagtatcgtttgtatttttagtcattgcaatgattagtagtgctttgtcaattgtaaaagttgctaaaatcgacccagtcgaagttattaatgggggaggagaa

SEQ ID NO: 8980 - protein, 362 aa, Streptococcus agalactiae
MSHAWKELTFYKKKYLLIELLIIVMMFMVVFLSGLANGLGRAVSAAIENNPAQTYILNEGAEQVITSSVLTTKDQTDLNSLNLKDSTTLNIQRSSLTRQGHEKKIDISYFAIDKDSFMAPTLSEGKQLTSYKKAIILNDSLKAEGIKLGDKVIDKSSSISLTVVGFVHNSMYGHGPVAFIDKDIYTEINKKINPQYQFLPQALVMKNDKSISHLPTQLEAVSKKDVIQHIPGYSAEQSTLNMILWVLVVASAGILGVFFYIITLQKRHEFSVMKAIGTKMSEIALFQLSQVIILALFGIIVGDGLAVALSYVLPAQMPFVINWQNIILVSFVFLVIAMISSALSIVKVAKIDPVEVINGGGE

SEQ ID NO: 8981 - DNA, 1068 bp, Streptococcus agalactiae
atgactaagctaaggcgatttcggtttccgttaagattttatttcacattaatgtttgtgttaacgatgcttttctcagtcctagcttctcttttactagttgcagcaatagtttttactttttttcaaggagtcttaactactcatgtattacaagttagtgctctcgctgttgtttttttaagccttgtgatagctagtattagtatgtggtacggttcttatcatttaacaaaaccaattttagatattagccatattgtgtccaatgttgcagacggtgactttgaagggcatatttatcgaaacagtaatcgtcgtaaatcctatgagtattataatgaattggatgagctatctgaaagtattaatcagatgattgtttctttatctcatatggatcatatgcgaaaagactttatcactaatgtttctcatgagctaaagactccgattgctgcagtagctaatattgtagaactattacaagatccagaattagatgaagaaacacaaagtgagttattaggtcttgttaaaacagagagcctaaggttaacaagattatgtgatacgatgttgcaaatgtcgcgcgtggataatcaggagactattggggagctatcctctgttcgtgtagatgaacaaattcgtcaagcaatgattagtttaacagaacgttggcaagctaaaaggataaattttcaactggattcaaaaccatatactgtttactcaaactctgacttgctgatgcaagtttggataaaccttttagataatgcaataaaatattccgaggatattgtagacttaagtgtacgaatggaagaaactaataatcattatctgagagttattatttctgataaaggtaggggaatttctcaatatgatgttcagcatatatttgataaattttaccaagcggatcagtcgcataatcaacaaggaaatggattaggactagcaatagttaaacgtataattgttctttgtaagggacgtattagtgtctccagtcagttggaaattggaacagaattttgtgtagaactacctttatca

SEQ ID NO: 8982 - protein, 356 aa, Streptococcus agalactiae
MTKLRRFRFPLRFYFTLMFVLTMLFSVLASLLLVAAIVFTFFQGVLTTHVLQVSALAVVFLSLVIASISMWYGSYHLTKPILDISHIVSNVADGDFEGHIYRNSNRRKSYEYYNELDELSESINQMIVSLSHMDHMRKDFITNVSHELKTPIAAVANIVELLQDPELDEETQSELLGLVKTESLRLTRLCDTMLQMSRVDNQETIGELSSVRVDEQIRQAMISLTERWQAKRINFQLDSKPYTVYSNSDLLMQVWINLLDNAIKYSEDIVDLSVRMEETNNHYLRVIISDKGRGISQYDVQHIFDKFYQADQSHNQQGNGLGLAIVKRIIVLCKGRISVSSQLEIGTEFCVELPLS

SEQ ID NO: 8983 - DNA, 2007 bp, Streptococcus agalactiae; identical to SEQ ID NO: 6623

SEQ ID NO: 8984 - protein, 669 aa, Streptococcus agalactiae
LAEMQHVNHSSFDKASKAGFIIALGIVYGDIGTSPLYTMQSLVENQGGISSVTESFILGSISLIIWTLTLITTIKYVLVALKADNHHEGGIFSLYTLVRKMTPWLIVPAVIGGATLLSDGALTPAVTVTSAVEGLKVVPSLQHIFQNQSNVIFATLFILLLLFAIQRFGTGVIGKLFGPIMFIWFAFLGISGLLNSFAHPEVFKAINPYYGLKLLFSPENHKGIFILGSIFLATTGAEALYSDLGHVGRGNIHVSWPFVKVAIILSYCGQGAWILANKNAGNELNPFFASIPSQFTMHVVILATLAAIIASQALISGSFTLVSEAMRLKIFPQFRSTYPGDNIGQTYIPVINWFLFAITTSIVLLFKTSAHMEAAYGLAITITMLMTTILLSFFLIQKGVKRGLVLLMMIFFGILEGIFFLASAVKFMHGGYVVVIIAVAIIFIMTIWYKGSKIVSRYVKLLDLKDYIGQLDKLRHDHRYPIYHTNVVYLTNRMEEDMIDKSIMYSILDKRPKKAQVYWFVNIKVTDEPYTAEYKVDMMGTDFIVKVELYLGFKMRQTVSRYLRTIVEELLESGRLPKQGKTYSVRPDSNVGDFRFIVLDERFSSSQNLKPGERFVMLMKSSIKHWTATPIRWFGLQFSEVTTEVVPLIFTANRGLPIKEKSELTTTGD

SEQ ID NO: 8985 - DNA, 624 bp, Streptococcus agalactiae
atgaagaagcttacttttatttgggatttagatgggacattaatagattcgtatgtaccaattatggaagctcttgaagaaacctatcgtcattttggtttaatatttgataaagaattaatccatgaatatattttacaggaatcagtggggaaattattggtaaacctttcagaggaagagcaaatacctcatgaaaaactgaaagcatattttacaaaagaacaagaaagtcgagattctaaaatacatttaatgccatatgcaaaagagattttagaatggaccaaagaacaagatatccccaattttatgtatacacataaaggagcaagtacgcattcagtgttggaaaccttgcagatctctcattattttgatgaaattttaactggtgtttcgggattcgagcgaaaaccacatccacaagggattaattatttagttaaacgatattctttagataaatcaatgacttattacataggagatcgtccactagatttggaggttgctcaaaatgctggtataaaatccataaacttaaggttagagaattccaaagaaaactataatatttcaagtctcaaagatataatatcacttgatttcactcgtttggat

SEQ ID NO: 8986 - protein, 208 aa, Streptococcus agalactiae
MKKLTFIWDLDGTLIDSYVPIMEALEETYRHFGLIFDKELIHEYILQESVGKLLVNLSEEEQIPHEKLKAYFTKEQESRDSKIHLMPYAKEILEWTKEQDIPNFMYTHKGASTHSVLETLQISHYFDEILTGVSGFERKPHPQGINYLVKRYSLDKSMTYYIGDRPLDLEVAQNAGIKSINLRLENSKENYNISSLKDIISLDFTRLD

SEQ ID NO: 8987 - DNA, 1149 bp, Streptococcus agalactiae; identical to SEQ ID NO: 6649

SEQ ID NO: 8988 - protein, 383 aa, Streptococcus agalactiae
LNSKLSLKLTILSISIFLMSHLAIAPAIPKLYAFYHTQNPHIGLASVESLVTIPAMMITIFVILSNFVVTKLGKKNTVLLGLCLILMSGFISFFTSNFSLAMASRLLLGIGIGLYNSLSISIITDLYEADERASMIGLRTASLNIGKALTTFIVGLVLAIGVNYIYLVYLLVIPVFFFFWKNVPEVENQTHTLKASTTFDTKAALLMLITFLVGIAYIGATVKIPTLLVTKYHYATSFSSNMLTLLAFSGILVGSVFGKLVKVFQEKTLLIMILAMGIGNVLFALANNQIIFIVASILIGASFVGTMSSVFFYISKNYAKEHNNFITSLALTAGNIGVILTPLILTKLPSQLHLEPFMTPFLITSGLMVINVFVYLVLMSKNK

SEQ ID NO: 8989 - DNA, 414 bp, Streptococcus agalactiae
atgtttgaaatagtattggaaaaaattaaatcgcataaatgggagacaacaggaattattgtaggactcttattatttggaattttgggtttaaatcattttggcactcatcataaagaagacaatttaaatatcaatttagagaaaaaagtatcaactataacagaaaaaaaggtaccaatgattagtcacgtcaaagataaagtatctaatcaagtaacggttgacgtaaaaggggcagtcaatcatccaggtgtttatagtttgccttctcaaagtcgtgtaacagatgcgattaagcgtgcaggtggactaagcaatctcgctgatagtaaatccgttaatctagcacagaaattacaagatgagacggttatctatgttgctcaaaaaggtgaaaaaataactgttgtg

SEQ ID NO: 8990 - protein, 138 aa, Streptococcus agalactiae
MFEIVLEKIKSHKWETTGIIVGLLLFGILGLNHFGTHHKEDNLNINLEKKVSTITEKKVPMISHVKDKVSNQVTVDVKGAVNHPGVYSLPSQSRVTDAIKRAGGLSNLADSKSVNLAQKLQDETVIYVAQKGEKITVV

SEQ ID NO: 8991 - DNA, 1584 bp, Streptococcus agalactiae; identical to SEQ ID NO: 6731

SEQ ID NO: 8992 - protein, 528 aa, Streptococcus agalactiae
LKFTELNLSQDILSAVEKAGFVEPSPIQEMTIPLALEGKDVIGQAQTGTGKTAAFGLPTLNKIHTEDNTIQALIIAPTRELAVQSQEELFRFGRDKGVKVRSVYGGSSIEKQIKALRSGAHVVVGTPGRLLDLIKRKALKLNHIETLILDEADEMLNMGFLEDIEAIISRVPETRQTLLFSATMPDPIKRIGVKFMKDPEHVKIKATELTNVNVDQYYVRVKENEKFDTMTRLMDVDQPELSIVFGRTKRRVDELTRGLKLRGFRAEGIHGDLDQNKRLRVIRDFKNDHIDILVATDVAARGLDISGVTHVYNYDIPQDPESYVHRIGRTGRAGKSGQSITFVSPNEMGYLTIIENLTKKRMTGMKPATASEAFQAKKKVALKRIARDFEDQELVSKFDKFKADALELATQYTPEELALYVLSLTVQDPESLPEVEITREKPLPFKPSGGGFKGKGGRGNGRGGDRRRNDRGDRRGNRDRDDRGSRCDFKRRDDKFKKDNRRQENKKPHKNTSSEKQTGFVIRNKGDK

SEQ ID NO: 8993 - DNA, 591 bp, Streptococcus agalactiae
atgcttatgacaaaaataataggactgacaggagggatagcttctggaaagtcaacggtaacaaaaataatacgagaatcaggttttaaagtcatagatgcggatcaagtggttcataaattgcaagctaagggtgggaaactttaccaagctttattagaatggttgggtcccgagatacttgatgctgatggtgagttggatagaccaaagctttctcaaatgatttttgctaatccagacaatatgaagacatcagctaggctacaaaatagtatcattcgtcaagagttagcatgtcagcgcgaccaattaaaacaaacagaagagatatttttcatggatattcctttattgattgaagaaaagtatataaaatggtttgatgagatttggttggtatttgttgataaagaaaaacaattacaacgattaatggcccgtaacaactacagtcgagaagaagcagaattacgactttcacaccaaatgcctttaacagataaaaaaagtttcgctagtcttattattgacaataatggtgatttaataactttaaaagagcaaatattggatgctcttcaacgttta

SEQ ID NO: 8994 - protein, 197 aa, Streptococcus agalactiae
MLMTKIIGLTGGIASGKSTVTKIIRESGFKVIDADQVVHKLQAKGGKLYQALLEWLGPEILDADGELDRPKLSQMIFANPDNMKTSARLQNSIIRQELACQRDQLKQTEEIFFMDIPLLIEEKYIKWFDEIWLVFVDKEKQLQRLMARNNYSREEAELRLSHQMPLTDKKSFASLIIDNNGDLITLKEQILDALQRL

SEQ ID NO: 8995 - DNA, 1218 bp, Streptococcus agalactiae; identical to SEQ ID NO: 6813

SEQ ID NO: 8996 - protein, 406 aa, Streptococcus agalactiae
LKNLNRYVVAVSGVVLHLMLGSTYAWSVFRNPIISETGWDISSVSFAFSLAIFCLGMSAAFMGHLVERFGPRIMGMISAILYGAGNVLTGLAIETQQLWLLYVAYGILGGIGLGSGYITPVSTIIKWFPDRRGLATGFAIMGFGFASLVTSPLAQSLMIRIGVGKTFYILGLVYFFVMMIASQFIKQPPQEKITILTHDGKKNAMNSQIITGLKANAAIKSKTFYIIWLTLFINISCGLGLISAASPMAQDLAGYSAESAALLVGVLGIFNGFGRLLWASLSDYIGRPLTFIILFIVNFIMTSSLFLSFNAIVFAIAMSILMTCYGAGFSLLPAYLSDIFGTKELATLHGYSLTAWAIAGLFGPLLLSKTYSWGNSYQLTLMVFGFLFLFGLLLSLYLRKLTTKVV

SEQ ID NO: 8997 - DNA, 2043 bp, Streptococcus agalactiae
atgttgaatcgtaaaaaaaggtatcgtctcactgtaaaaaagcaaaatgctagcatacctagacgattaaatcttctattttttattattgktttattatttactgttctaattcttcgtttagagcaaatgcagattgggcaacaatcattttacatgaaaaaactgacagctcttacgagttatacagtgaaagaatcaaaagcgagaggtcagatttttgatgctaagggagttgtcttagttgaaaatgatgaacgtcctactgtggcgttttctagaggaaacaatatttcatctcagtctatcaaagagttagcgaataaattatcacattacattaccttaaccgaagttgcttcaagcgatagagcaaagagagattattatttagcagataaagccaactacaaaaaagttgttgaaagtttaccagattctaaacgttacgataaatttggtaaccatctagccgaatcaaccgtatatgcaaatgcagttgctgcagttccagtgagcgctattaactattctgaagatgagttaaaagtggttgccttatttaaccaaatgaatgcgacaccaacgtttggttcagtgaaattaagtacaggcgaattaagtgatgatcaaatcaagaaactggatgctgataagaaggaactgttaggaatttctgtaacaagtaattggcatcgtcgtaaaaaaggaacttctttatcggatatattaggtactatttctacagaaaaggcaggtttaccaagagaagaagttaaaaaatatttgaaaaaaggctattcactgaatgaccgagtgggaacttcttaccttgaaaaacaatatgaagatgacttacaaggaatcagacaaattcgcaaagtagttgttaataaaaaaggtaaagttgtttcagataatattacgcaagaaggtaagtcaggaagaaatcttaaattaacgattgatcttaattaccaaaacaaagtagaaagtatcttgaaacaatactatggcagtgaattatctagtggacgcgctagtttttccgaagggatgtatgcagttgctatagaaccttcaactggtaaagtgttagcaatggctggtctgaaaaatgatcatgggaatttagttgatgacagcctaggcactattgctaagaatttcacgccaggatctgttgtgaaaggtgcgacgctatcatcaggatgggaaaataaagttcttagaggaaatgaagtgctttatgaccaagaaattgctaatatacggtcatggtttacacgaggtttgactccaatatctgcggcacaagcgctagagtattcatctaatacttatatggttcaagtagcacttcgtttaatgggacaagactataatacaggagatgctttaactgatcgaggctatcaagaagcaatggctaaactaaggaaaacttacggcgaatatggtttaggggtttctacaggattagatttacctgaatcagaaggttatgtacctggaaaatacagcttaggaacaactctaatggaatcgttcggtcagtatgatgcctatacaccaatgcaacttggtcagtatatctcaactattgcgaataatgggaatcgtttagcacctcacgtggtttcagatatctatgaagggaatgattctaataagttcgctcaattggttcgttcaatcactcctaaaacactaaataagatagctatctcagatcaagagttagccattattcaagaaggtttttataacgttgtcaatagtggaagtggctatgcaactggtacgtcaatgagggggaatgtgacaaccattagtggtaaaactggtaccgctgaaacatttgctaaaaatgtaaatggacaaacagtttctacctacaacttaaacgctattgcctacgatactaatcgtaaaatagcagtagcggtaatgtatccgcatgttacaactgatacaacaaaatcccatcaattagttgcacgagatatgattgatcaatatatttcacagttcacaggacaa

SEQ ID NO: 8998 - protein, 681 aa, Streptococcus agalactiae
  MISC_FEATURE (1)..(681): Xaa = Any Amino Acid
MLNRKKRYRLTVKKQNASIPRRLNLLFFIIXLLFTVLILRLEQMQIGQQSFYMKKLTALTSYTVKESKARGQIFDAKGVVLVENDERPTVAFSRGNNISSQSIKELANKLSHYITLTEVASSDRAKRDYYLADKANYKKVVESLPDSKRYDKFGNHLAESTVYANAVAAVPVSAINYSEDELKVVALFNQMNATPTFGSVKLSTGELSDDQIKKLDADKKELLGISVTSNWHRRKKGTSLSDILGTISTEKAGLPREEVKKYLKKGYSLNDRVGTSYLEKQYEDDLQGIRQIRKVVVNKKGKVVSDNITQEGKSGRNLKLTIDLNYQNKVESILKQYYGSELSSGRASFSEGMYAVAIEPSTGKVLAMAGLKNDHGNLVDDSLGTIAKNFTPGSVVKGATLSSGWENKVLRGNEVLYDQEIANIRSWFTRGLTPISAAQALEYSSNTYMVQVALRLMGQDYNTGDALTDRGYQEAMAKLRKTYGEYGLGVSTGLDLPESEGYVPGKYSLGTTLMESFGQYDAYTPMQLGQYISTIANNGNRLAPHVVSDIYEGNDSNKFAQLVRSITPKTLNKIAISDQELAIIQEGFYNVVNSGSGYATGTSMRGNVTTISGKTGTAETFAKNVNGQTVSTYNLNAIAYDTNRKIAVAVMYPHVTTDTTKSHQLVARDMIDQYISQFTGQ

SEQ ID NO: 8999 - DNA, 651 bp, Streptococcus agalactiae
atgtttaatacaattggtcgcgctcaggggtggagtgatactcctttaactacttttggagaactcgggattaaagagcttggtttgggactaaaggcttcaaatattagttttaaagaggctttttctagtgatagtgracgtactttacaaactatggaaattattctcagggaagtgcaacaagaaaatattccctatacgagagataaacgaatccgcgagtggtgctttggtagtttggatggaggatatgatggcgacctttttaatggcgttctgcctcgagtttcaaacggagatatgagccatttgacacacgaagaaattgctaatttgatttgtcaagttgatacggctggctgggcagaaccgtgggcaatattgagtaaccgtattctgtcaggcttcactgctatagctaaaaaaatagaggatattgggggaggtaatgcgattgttgtcagtcatgggatgactattgcgacttttttatggttaatcgaccatagtacccctcgtagtttaggcttagataatggtagtgtctcagtcgttgattttgaagatggaacattttctattcaatctattggggatatgtcctatcgagaaaaaggaagagaaattttagaaaaaacattgcaatga

SEQ ID NO: 9000 - protein, 216 aa, Streptococcus agalactiae
  MISC_FEATURE (1)..(216): Xaa = Any Amino Acid
MFNTIGRAQGWSDTPLTTFGELGIKELGLGLKASNISFKEAFSSDSXRTLQTMEIILREVQQENIPYTRDKRIREWCFGSLDGGYDGDLFNGVLPRVSNGDMSHLTHEEIANLICQVDTAGWAEPWAILSNRILSGFTAIAKKIEDIGGGNAIVVSHGMTIATFLWLIDHSTPRSLGLDNGSVSVVDFEDGTFSIQSIGDMSYREKGREILEKTLQ

SEQ ID NO: 9001 - DNA, 753 bp, Streptococcus agalactiae
atgaaaaaaaataaaattatccgattcagtttagttggtgttctacttgcgatactatgctttagtctttttgctttattgaagcctaacagtcaacaatcatcatctcaaaagttgaggaatgaggatataaaaaagatatcctctcaaaaaagaaataagaaattacaattaccagctgtatcatcaaaagattggaacttgattttggtcaatcgtgaccataaacatgaagaattaagtccagatgtggttcctgttgaaaatatttatttggataaacgtattacgaagcaagctactcagtttttagaggctgctagagcaattgattcacgagaacatttaatttcgggttatcgtagtgttgcctatcaggagaagttgttcaattcttatgttactcaagagatgactagtaaccctaatttgacgaggggacaagcagaaaagttggtaaaaacttactctcagcctgcaggtgctagtgaacaccagactggattagcgatggatatgagtactgtagattctttgaatgagagcgatcctagagtagtcagtcagttgaaaaagatagctccacaatatggttttgtcttacggtttccggatggtaaaacagcagaaacaggggtaggttatgaagattggcattaccgctatgttggggtagagtctgcaaaatatatggccaaacatcatttaacattagaagaatacataactttattaaaggagaataaccaatga

SEQ ID NO: 9002 - protein, 250 aa, Streptococcus agalactiae; identical to SEQ ID NO: 6860

SEQ ID NO: 9003 - DNA, 1524 bp, Streptococcus agalactiae
atgaaaaaaaaactatctctttgggcatttctatcattgattttagtcactatgaccatttgtatattttctattttttattatgtcactatacatcagtcctatcgtatggtaagggtacaggaagaaaaaatcttaaaaaatactggttatgctttatcgagaaatccacaagttatacaaacactcaaagataatcactatgatcaaagtctccaaaaacaaatgttattccttagcaaaaaatcaaatttagactatattgtccttataaatttaaaagggatccgttttacccaccctgactccactaagattggtaaaccatttcaagggggtgatgaacaagctgtttttaagggaaaagctattatgtctactgcagaaggttctttaggaaaatctttacgatacttaattccagtatatgatcaccaaaaacaggttggggcaattgcagttggcttaaaattaacgacacttggagacttatctcaaagtagcataaaagagtttagtaagcctctcttgattagtattttgattagcttagtcgtcacaagtataatttcttatggcttaaaaaaacaacttcacaacctccatccaagtgatatttttcaacatttagaagagcgcaatgcaacactggaccaaattcaagccgctgtatttgttattgaccagaggcatatcatcaaaagaaataatcctgcagctagtttattattcaaaaaagaggggcaacgagacctattttcaggtaaattattagaatctttaattcctcaactcaagcaggatcatttttcaaaaaaaactgaacaagtattacattttcaaggacaagactatttactatctatctcgccaattacggttaaaacacaaaatagaggctatgttgtcttcttaaggaatgttactgaaacacttttcactttggatcaattagcacacactacagcttatgcttctgcgctacaggcccaaacacatcaatttatgaatcaacttcatgttatttatggacttgcagacattgaatactacgacgagttgaaaatttatttaaaagaattattggagccacaaaatgaatttttagcacgcttatcaatgttagttagagagcctcgactggctagtttcattattggcgaaagagaaaaattcgcagaaaaacacatcaatctatccacagaaattttagtagaaatccctaccaagtcaactgttgaggatgttaataactatctcttgctccacagatatattaatacgaagatactcacgctattaaattcaacgactttagtttctttacgtttaaattatcaaaataacctcattgaaacagattatcaatgggagaatgagaagtggttactcaatgactaccatcagtatttcaacgacgcttattttcaacagttacttgtagattcaagagctacttataagatctctttaaaacaaaataaggttattataagaacaaatattatctactcagaagggcct

SEQ ID NO: 9004 - protein, 508 aa, Streptococcus agalactiae
MKKKLSLWAFLSLILVTMTICIFSIFYYVTIHQSYRMVRVQEEKILKNTGYALSRNPQVIQTLKDNHYDQSLQKQMLFLSKKSNLDYIVLINLKGIRFTHPDSTKIGKPFQGGDEQAVFKGKAIMSTAEGSLGKSLRYLIPVYDHQKQVGAIAVGLKLTTLGDLSQSSIKEFSKPLLISILISLVVTSIISYGLKKQLHNLHPSDIFQHLEERNATLDQIQAAVFVIDQRHIIKRNNPAASLLFKKEGQRDLFSGKLLESLIPQLKQDHFSKKTEQVLHFQGQDYLLSISPITVKTQNRGYVVFLRNVTETLFTLDQLAHTTAYASALQAQTHQFMNQLHVIYGLADIEYYDELKIYLKELLEPQNEFLARLSMLVREPRLASFIIGEREKFAEKHINLSTEILVEIPTKSTVEDVNNYLLLHRYINTKILTLLNSTTLVSLRLNYQNNLIETDYQWENEKWLLNDYHQYFNDAYFQQLLVDSRATYKISLKQNKVIIRTNIIYSEGP

SEQ ID NO: 9005 - DNA, 594 bp, Streptococcus agalactiae
atgaccaaaaagatattcttatttatctgcgctactcttttagtaggaatagccttatatacaccaacaacttctatttttaatcataacaacgtttatgctgccaccaagaaagcaaaaattaaatttaataaaactcaaaaaaaaattgtcaaaaaagcaagagaatatgctaagtctggccatatgtctaaagatagtatcattgaaaaattaaaaaaggattctaagaaatatcgtcaagaagacatcaactttgtgattaataacctcaaggttgattacaaaaaaaatgccttgatttctgccaaaatttattcaaagaccatgaatttatctaaacaatctatctttgaacagctctattcggagtctccagataaggcaacccactctgataaatttacaaaagaagaatcccaatatgctatagaccatctcaaagtagatttcaaagaaaatgctcttgagactgctaaaagttatcaaagtagttcttctttatccaaagaagaaatctataaacaattgacatctacgctgggcgataaattcacaaatgatgaagcccaatatgctgtagatcatttgaaa

SEQ ID NO: 9006 - protein, 198 aa, Streptococcus agalactiae
MTKKIFLFICATLLVGIALYTPTTSIFNHNNVYAATKKAKIKFNKTQKKIVKKAREYAKSGHMSKDSIIEKLKKDSKKYRQEDINFVINNLKVDYKKNALISAKIYSKTMNLSKQSIFEQLYSESPDKATHSDKFTKEESQYAIDHLKVDFKENALETAKSYQSSSSLSKEEIYKQLTSTLGDKFTNDEAQYAVDHLK

SEQ ID NO: 9007 - DNA, 366 bp, Streptococcus agalactiae
atgactatttctcaacaacaataccaacacatgataacaaatagtgacttaatcgccatcacagataaggcgttagtaagcaaaagtcaacaatctgaagcgactatttttataggacgtccaacttgccaatattgtagagctttcttaccaaaattattaaaatctcaagccacacttcattcaaaaatttactaccttgatagtcaaaaatacaaagggaaacgattgaagagttttttcaaaaagcatcatattaccactgttccaaatttagcacattatcaacaaggaaaaatgactaaatatcttgttcaaggaagccaagctacacctcaacaaatccaaactttcttaagccaaaaa

SEQ ID NO: 9008 - protein, 122 aa, Streptococcus agalactiae
MTISQQQYQHMITNSDLIAITDKALVSKSQQSEATIFIGRPTCQYCRAFLPKLLKSQATLHSKIYYLDSQKYKGKRLKSFFKKHHITTVPNLAHYQQGKMTKYLVQGSQATPQQIQTFLSQK

SEQ ID NO: 9009 - DNA, 540 bp, Streptococcus agalactiae
atgtcaattattattgggttaatggccgctatgtttattattcgtttagcttatttaaagctatctatagctaatgaaaaggccttaagaaaaaatggtgctaaagaatatggtgtaggtgtttcaaaagcaatcacagttcttcatattatcatttatttttcatctgtaactgaggctattctaacaaaagcaagttttaattttgttagcgtaatcgggcttagcttgatgattttttctgtgtttatgttacatacagtaacacgtttacttggtcgtatttggacagtgaaattaatggtagataaaaatcatcaatttgtagatcactggttatttagggttgttaagcatcctaactatttcttaaatattgctcctgaacttttaggtgtaactttattgtgtcatgctaaatacacagcattatttgtcttgccaatttatgcttttgttatttatttaagaattcgtgaagaaaacttattattaaaaacgatcattattccaaatggaatcaaaaagtctagggtatat

SEQ ID NO: 9010 - protein, 180 aa, Streptococcus agalactiae
MSIIIGLMAAMFIIRLAYLKLSIANEKALRKNGAKEYGVGVSKAITVLHIIIYFSSVTEAILTKASFNFVSVIGLSLMIFSVFMLHTVTRLLGRIWTVKLMVDKNHQFVDHWLFRVVKHPNYFLNIAPELLGVTLLCHAKYTALFVLPIYAFVIYLRIREENLLLKTIIIPNGIKKSRVY

SEQ ID NO: 9011 - DNA, 498 bp, Streptococcus agalactiae
atggaatcatatgaacaattttatgccaaactatctcaaccttttagaaaatccccacagttaataattcttttaaattttttactaaaaatagtcacaggaatgatgtacatactctatccatcttttctgatatttactctttggcaagggatgacatttcaattatggttaaggctattaattatccctgctgttggctttatagctttgtcttacattaggaaacgccttgattttccacgaccatatgaaaaatggaatattaaacctttaatttataaggatactgagggaaggtcaatgcctagcagacatgttttttcagctacgatgattagtatgtgtttgttacgatattatgtttactttggaatagtttgtttaatattatcggttctattggcaatttgccgtgtgatagcaggtattcactatcctaaggatgttattgtaggttaccttattggcttgattttagggctttgtttatttatt

SEQ ID NO: 9012 - protein, 166 aa, Streptococcus agalactiae
MESYEQFYAKLSQPFRKSPQLIILLNFLLKIVTGMMYILYPSFLIFTLWQGMTFQLWLRLLIIPAVGFIALSYIRKRLDFPRPYEKWNIKPLIYKDTEGRSMPSRHVFSATMISMCLLRYYVYFGIVCLILSVLLAICRVIAGIHYPKDVIVGYLIGLILGLCLFI

SEQ ID NO: 9013 - DNA, 351 bp, Streptococcus agalactiae
atgatatacaaaattattgcttctttatttcttgttttaatccctatattttcacaggttcttgtcaaaatatttaaacttaaaaaatttaacattatgtttccagatgttgcttttcctatttttgtttttttaattccattaatatcatctagtctgttaaaacaaaatcttttaccttactatctgattctcatttcattactggcaatcggaattacaataaagcttctacgaacaaagactcttttttcttataaacgttttttaaaattattttggagatctggctttattctaactttccttttttacctaggattattggttatcatctttatcaaagtacaa

SEQ ID NO: 9014 - protein, 117 aa, Streptococcus agalactiae
MIYKIIASLFLVLIPIFSQVLVKIFKLKKFNIMFPDVAFPIFVFLIPLISSSLLKQNLLPYYLILISLLAIGITIKLLRTKTLFSYKRFLKLFWRSGFILTFLFYLGLLVIIFIKVQ

SEQ ID NO: 9015 - DNA, 201 bp, Streptococcus agalactiae
gtgaggcgtaatatggcatctagtggttggaaatatgtattaaaacaaatcggtctaatagtattagtcatactattagccttgctgtttttagcggttggattgatgttgggttatagtgtttttggtgacggagagcatgcttactctattttatcgctggataaatggcaaaatattattggaaaatttttaggaaaa

SEQ ID NO: 9016 - protein, 67 aa, Streptococcus agalactiae
VRRNMASSGWKYVLKQIGLIVLVILLALLFLAVGLMLGYSVFGDGEHAYSILSLDKWQNIIGKFLGK

SEQ ID NO: 9017 - DNA, 411 bp, Streptococcus agalactiae
atgatggaaaaaattaggatttaccataacccaaattgtgggacatcaaggaacgtacttgccattattcgtcattgtggtattgaaccagaaattatttattatctgaaaacaccacctagcaggatggaactggttgaactgttgttagaaatgaaactttctgcgagggaacttctaagaacagatgttcctgcttatgagaaattcaatttggaatcttctagcgttacagatgaagaaatgattgatgcgatgatacaagatcctattcttatcaatcgtcccatagttgttacgagtaaaggtgcaaaactctgccgaccctgtgaagcaattttaaccattttacctgtaaagatggaaaaagattttgttaaagaagatggacagattatccaaagtttatga

SEQ ID NO: 9018 - protein, 136 aa, Streptococcus agalactiae
MMEKIRIYHNPNCGTSRNVLAIIRHCGIEPEIIYYLKTPPSRMELVELLLEMKLSARELLRTDVPAYEKFNLESSSVTDEEMIDAMIQDPILINRPIVVTSKGAKLCRPCEAILTILPVKMEKDFVKEDGQIIQSL

SEQ ID NO: 9019 - DNA, 291 bp, Streptococcus agalactiae
atgaaacttaaaatcagtgttttaacagcagcttcagctgtcactctattattagctactttagcaagtcttgcgaaggcagacacagtgtcttatccttcacgtgatgccggatttgtctactctcgtgggtatgcgccttctgaatcaagctatccttcacgcgatgccgggtttatctactctcgtgggtatgcgccttctgaatcaagctatccttcacgcgatgccggatttatctactctcgtgggtatgctccaaaacacttcctaagtgcttacgataaataa

SEQ ID NO: 9020 - protein, 96 aa, Streptococcus agalactiae
MKLKISVLTAASAVTLLLATLASLAKADTVSYPSRDAGFVYSRGYAPSESSYPSRDAGFIYSRGYAPSESSYPSRDAGFIYSRGYAPKHFLSAYDK

SEQ ID NO: 9021 - DNA, 453 bp, Streptococcus agalactiae
atgttaataaaaggattattgtcacccaatagtaaagtatctccgaaggattacaaagtatatatgagagttttgtcttttgtttttagtgtatgtagtttgattatgatagtatcatcatttctacatacctttgaatctaattttactaaaggtttttcctttggttcaggtattgccttatttgcaggaagtttttattttttggtgataacatttagtgaaaagcgatttcaacattactataccaaagtttttgatgagcgtaatcaatttattgctaatatgtcttgtcgacttcttttccttttatctgtccttgttttagtggtattgtgtctgattaatgtctggtttggtataactttttcctatgcaaagttcttgctattgatactctcttttattttatatggttatttattaatttactttattttacagaagttattg

SEQ ID NO: 9022 - protein, 151 aa, Streptococcus agalactiae
MLIKGLLSPNSKVSPKDYKVYMRVLSFVFSVCSLIMIVSSFLHTFESNFTKGFSFGSGIALFAGSFYFLVITFSEKRFQHYYTKVFDERNQFIANMSCRLLFLLSVLVLVVLCLINVWFGITFSYAKFLLLILSFILYGYLLIYFILQKLL

SEQ ID NO: 9023 - DNA, 204 bp, Streptococcus agalactiae
atgaacactaacatccctagccaatttttacctttctttatccctcttatcctcttacaggttatccttatcatcattgcactcttaaaattacgaaaaataacaaagacaaactacctttctaaaccagtttgggttctaattatcctttttgttaatctccttggacctattgcttttcttagcttagaagggaaaaatgca

SEQ ID NO: 9024 - protein, 68 aa, Streptococcus agalactiae
MNTNIPSQFLPFFIPLILLQVILIIIALLKLRKITKTNYLSKPVWVLIILFVNLLGPIAFLSLEGKNA

SEQ ID NO: 9025 - DNA, 471 bp, Streptococcus agalactiae
gtgggaggaaatgaaatattaattaataaacggttaagaacaatctccttactacattatctgttagcgctactacttcttatagacattatctttacgattgattttataattcacacgtcaacaatttccaaaaatagtctatcatatataagttatggtcaaggatttggttggtctatgattcttattaatttgatagctctacctatttgtttcctagtagaattgtcagctggtctactattaaaattagaaatgcataagcaacatggctactatcctctggaacgcttattgatgactggtaatattctaacagttgtatcgctagtattattacatactttgattcacaatatcaattcacttctttttttatcaattacagtagttttattgatttctgggaagtccttaagtcttattagtatctatctattaaaaagaaaaagtaaacatcaaaaagtc

SEQ ID NO: 9026 - protein, 157 aa, Streptococcus agalactiae
VGGNEILINKRLRTISLLHYLLALLLLIDIIFTIDFIIHTSTISKNSLSYISYGQGFGWSMILINLIALPICFLVELSAGLLLKLEMHKQHGYYPLERLLMTGNILTVVSLVLLHTLIHNINSLLFLSITVVLLISGKSLSLISIYLLKRKSKHQKV

SEQ ID NO: 9027 - DNA, 351 bp, Streptococcus agalactiae
atgagtttagcattgcaaattgaaatgtttattttagccattgtcctactttatatgattataagaatggttaataaaaacacattttctgttaaacgttctttaccttggctattagttggtttaattctagtctttattagtgtatttcctggggtggtctcatttatcgctcatcaccttggattcgctttaacgatgaatttcttgttatttggtgctattttatttctgttttgtttagaattatttgatactagtagcaataccaaaagagatgagcaaattaaacgcctgattcaagaggtttctttgttgaaaaaagagatagaggatagcactttagatgag

SEQ ID NO: 9028 - protein, 117 aa, Streptococcus agalactiae
MSLALQIEMFILAIVLLYMIIRMVNKNTFSVKRSLPWLLVGLILVFISVFPGVVSFIAHHLGFALTMNFLLFGAILFLFCLELFDTSSNTKRDEQIKRLIQEVSLLKKEIEDSTLDE

SEQ ID NO: 9029 - DNA, 450 bp, Streptococcus agalactiae
atgtcaaaaggatattcaagacaacagaaaaagtctactaagactaatactgattcaactcaatcacccgctaagcatataaaaacaggtttttctgcacttcaaaaaacaattgcattagtcggtagtgttttaagtattattgttgcctctattactattactaatgcgattaataatcacaaagactctagtaagactgattcttctacttcaaaaaccgtcattataagagaaagtggacaaaattctagtaaccaagtttctactgaaaaagatgagacaagggcatcatccagccaaacactagaaaattcctctgctagtagtactccgagtagcagttcaaattctgctgccaataacgatcaaacatcatctagtactaacaatgatcaaacaaataatactactaccgatacctcaactattgaaaatacaacaacacct

SEQ ID NO: 9030 - protein, 150 aa, Streptococcus agalactiae
MSKGYSRQQKKSTKTNTDSTQSPAKHIKTGFSALQKTIALVGSVLSIIVASITITNAINNHKDSSKTDSSTSKTVIIRESGQNSSNQVSTEKDETRASSSQTLENSSASSTPSSSSNSAANNDQTSSSTNNDQTNNTTTDTSTIENTTTP

SEQ ID NO: 9031 - DNA, 399 bp, Streptococcus agalactiae
atgcataatatattaagatttttaggcattgttattatttctgcagtgattctatttagtataggtagtttctacgatttaacattaatgaaaaatatactacttatctgttggagttttctctttgatctattggtttttgtcttcaaacaaagacaaacgacagaagtactcacatggtatcaagttgttaagcaattttggttatttattaagtgtactattcttattcctatcttagttgcttttattataatgaaaggatgtttgacaagtatatcagatatattaatttacttttatttacaccttgtcgttgtttattatacgataggaatgattttatcattaggtcgtatcatttctcctgaacactctatgtttaataaacttagaaag

SEQ ID NO: 9032 - protein, 133 aa, Streptococcus agalactiae
MHNILRFLGIVIISAVILFSIGSFYDLTLMKNILLICWSFLFDLLVFVFKQRQTTEVLTWYQVVKQFWLFIKCTILIPILVAFIIMKGCLTSISDILIYFYLHLVVVYYTIGMILSLGRIISPEHSMFNKLRK

SEQ ID NO: 9033 - DNA, 453 bp, Streptococcus agalactiae
atggttaaattaaaatcgttactgaaaaaaagtattcaaaatgaagtcagcttatatttactgttcggactattaacatcccttctttatttagttattcgacaagggatttttaatttctcgcaggacgctccattctctgcaatagttgctaacataatagctatactttttgctttttttacaaatgatcgatttgtttttaaacaaactaaaattgaacagcttcaacgcttacaaacatttgtcatcgctagattaggcacattaggattagatttgatattagctgttatttttgttgatcaatttccttctattatcggacaattcgttcagcacaatttaaataaaatcaacaccattgaaagccttgtatctcaaatattaattattttactcaactacatcttgagcaaatttgttatttttaaagacaaaaaaagacaactc

SEQ ID NO: 9034 - protein, 151 aa, Streptococcus agalactiae
MVKLKSLLKKSIQNEVSLYLLFGLLTSLLYLVIRQGIFNFSQDAPFSAIVANIIAILFAFFTNDRFVFKQTKIEQLQRLQTFVIARLGTLGLDLILAVIFVDQFPSIIGQFVQHNLNKINTIESLVSQILIILLNYILSKFVIFKDKKRQL

SEQ ID NO: 9035 - DNA, 405 bp, Streptococcus agalactiae
atgaaaaagagtacccaaataatactactaatagttgcattattcatacttgtttttagcggaggattttatatgaaagaacaacaaagaaaagaagaactaaaacggaatcgagaatatgaagttagtctagtcaaagcattgaaaaattcctatgagaatatagaagaaataaaaatcacacatcctgtttcaactgaaattcctggagattggcattgtactgtaaagatttcatttaatgataaaaaatctattgtttataatattacacataatttggaatcgaaaaaaaattatagcggaaaatttaatgaaaaaaatatgaatttttttgattcaagaattggtaaaacaaaaaaaactataaaaattattttttcagatggtcaggagaagatacaa

SEQ ID NO: 9036 - protein, 135 aa, Streptococcus agalactiae
MKKSTQIILLIVALFILVFSGGFYMKEQQRKEELKRNREYEVSLVKALKNSYENIEEIKITHPVSTEIPGDWHCTVKISFNDKKSIVYNITHNLESKKNYSGKFNEKNMNFFDSRIGKTKKTIKIIFSDGQEKIQ

SEQ ID NO: 9037 - DNA, 297 bp, Streptococcus agalactiae
atgctagtatcaaaggagaaagctatgtcatcaccacttaagcaagagcaaactcacgaaagcaaaacagagcaagctcaaccaaaatttcaagtatttcaagaatttgatcacagtgctaagttgcgtgagctagtcttttttgctcgtatcgctctcttcagtataaccactgtgctaatctctttcttattactagcactaagtttaacacctgtctggagtttcttactagcgatgctggcaagtctagcagttacatctgcagtctcttcattcatttggtcactcagacaa

SEQ ID NO: 9038 - protein, 99 aa, Streptococcus agalactiae
MLVSKEKAMSSPLKQEQTHESKTEQAQPKFQVFQEFDHSAKLRELVFFARIALFSITTVLISFLLLALSLTPVWSFLLAMLASLAVTSAVSSFIWSLRQ

SEQ ID NO: 9039 - DNA, 465 bp, Streptococcus agalactiae
atgcttatgataataaattcattcgataatagtagaaaagcgattattaatcctgaagatattaattcaccaataaaaggttttccaaagactgttattacctgtttcgcgcgggagactttcaatcgtattttagaagaattgcctcatcgtgaaattgctagaactagtgtagcaaacttagaaattcccatttatgaattagaatttaaaggacaaaagattggctttttcaatgcttatgttggtgcttcagcttgcgtagcaatcttggaagatattatagtatttggaatggaaagtttaattgtttttggaacatgtggcgtccttgattcgtcaattgaggagacatccattattattccaagaagtgctattagggatgaagggacatcatttcattattcggaagcaagttctgaaattgcagtaaacacaaattcaatttttttactctgcgga

SEQ ID NO: 9040 - protein, 155 aa, Streptococcus agalactiae
MLMIINSFDNSRKAIINPEDINSPIKGFPKTVITCFARETFNRILEELPHREIARTSVANLEIPIYELEFKGQKIGFFNAYVGASACVAILEDIIVFGMESLIVFGTCGVLDSSIEETSIIIPRSAIRDEGTSFHYSEASSEIAVNTNSIFLLCG

SEQ ID NO: 9041 - DNA, 456 bp, Streptococcus agalactiae
gtgaaccacttacttaacctcagtaaagaaaatatagctaaaatagattttgactttcttaatgaggcacttaatgcaaatattcgtttgaaagaattagtagatgaactaaaaatttcaaaagaactggacagtaaaggttggtccaaaaaagactctcgaacgataaaaatcttgtacgatggccttatcaataaacatatagtttccctagatcgtgcagattataacattatccaagtcattccatttgctaatgtacatgtactactgtttttaataccagaaagggagaattctaaaaattatagaatatacaactacagtgattatgaaatggagttaatcaatgaggataggcaacaattttcaaaatatgaaacagttgatttagaccaattgatacttgttgatatttttaatattgatgactacatttcatcatatttaacaata

SEQ ID NO: 9042 - protein, 152 aa, Streptococcus agalactiae
VNHLLNLSKENIAKIDFDFLNEALNANIRLKELVDELKISKELDSKGWSKKDSRTIKILYDGLINKHIVSLDRADYNIIQVIPFANVHVLLFLIPERENSKNYRIYNYSDYEMELINEDRQQFSKYETVDLDQLILVDIFNIDDYISSYLTI

SEQ ID NO: 9043 - DNA, 348 bp, Streptococcus agalactiae
atgaaagactatattaacagaatattgcactttattaaagaacatatgacttatcatgtcaactttatagatgactttttagatattaaatgggaaaaggtgagtaacatccatttaaggttttggacaactattattgcttatttagttatttttatcttaagtatctctaccgtaattcttaaccttgtacttctttttcaaggattcttaacgcaaaaccctattatttacttactattttttataactttagtttgtgctttttattttgcttataaatttattacttatactccaaccattgtaaaaaatgctcttcagtatatcaaaaagctcaaaaacgtt

SEQ ID NO: 9044 - protein, 116 aa, Streptococcus agalactiae
MKDYINRILHFIKEHMTYHVNFIDDFLDIKWEKVSNIHLRFWTTIIAYLVIFILSISTVILNLVLLFQGFLTQNPIIYLLFFITLVCAFYFAYKFITYTPTIVKNALQYIKKLKNV

SEQ ID NO: 9045 - DNA, 201 bp, Streptococcus agalactiae
atgggattttttgcacagcgttgtccttactgccaaagtacaaaagtacaatttatgaaccaagaccgtaaaggttttaatggttgtgtcggttgtatcggatttttaattgcttggccgttcttattgctaggtttggttgggaaaaagggtaaaaacaactggcattgcacaaattgtggaagaacgtttaagacaaaa

SEQ ID NO: 9046 - protein, 67 aa, Streptococcus agalactiae
MGFFAQRCPYCQSTKVQFMNQDRKGFNGCVGCIGFLIAWPFLLLGLVGKKGKNNWHCTNCGRTFKTK

SEQ ID NO: 9047 - DNA, 393 bp, Streptococcus agalactiae
atgattatgtctaccatctattttatttctttatgcatgagttttatcttaagttattatgatataaaataccaagagtatcctatttttctatggatattattcaccatttcaacgataattctcacaccgattacaaaagtttctattgttttgtgtttatttgggattttagctgaagtggttgatattaatatcggaagtggagatttcctttatttagccacaattggcttatctttacctcttcatcaaatgctttttattattcaaataggtgcttggttaggaattatttattgtttagttatgagaaaaatgaaaaaaacgatagcttttctaccgtttttaagtatcgcttatataatcgtcaccagttactctcttttattc

SEQ ID NO: 9048 - protein, 131 aa, Streptococcus agalactiae
MIMSTIYFISLCMSFILSYYDIKYQEYPIFLWILFTISTIILTPITKVSIVLCLFGILAEVVDINIGSGDFLYLATIGLSLPLHQMLFIIQIGAWLGIIYCLVMRKMKKTIAFLPFLSIAYIIVTSYSLLF

SEQ ID NO: 9049 - DNA, 462 bp, Streptococcus agalactiae
atgagaaagattattataccaataataactattttgttgattgctttagatcaactatctaagttatggattgttaaacatattgaactaaaccaaattaaggaattcattccaaatatcgttagtctaacttatctgagaaattatggtgctgcattttctattttgcaaaatcaacaatggctttttaccttaattacaatcttcgttgttggtgttgctattatttatttgatgaaacatattaatggaagttattggttattaatttctctaaccttaatcatctctggtggattaggaaactttatagatcgcttaagattaggttatgtcgttgatatggtgcatttagattttattaattttgctatctttaatgtagcagactcatatctgacaatcggtattatttgcttaatgattgcactttggaaagaggaaagtaatggaaatcacaat

SEQ ID NO: 9050 - protein, 154 aa, Streptococcus agalactiae
MRKIIIPIITILLIALDQLSKLWIVKHIELNQIKEFIPNIVSLTYLRNYGAAFSILQNQQWLFTLITIFVVGVAIIYLMKHINGSYWLLISLTLIISGGLGNFIDRLRLGYVVDMVHLDFINFAIFNVADSYLTIGIICLMIALWKEESNGNHN

SEQ ID NO: 9051 - DNA, 369 bp, Streptococcus agalactiae
atgattttaaagaagaaacttaaagctggcatccttttgcaagctattgtattggctgctgtatttacactcgtcttacagttttatctagcaagaatattggcaacagaaagacagtatcatagccaaattgaagcaagtaaagcttatttaacagcgcagttagcttataaaacaatagaaggtgactccatatcaggaaaatgttattttacaggaggatatgcttcatacctccaagaagggaactatttacaagttaaggttacattggataagggaggaaactataaccataagttttatcgtaaaacagacactctccaagtacctctcaagtctaatgataataaagcaagccataaacat

SEQ ID NO: 9052 - protein, 123 aa, Streptococcus agalactiae
MILKKKLKAGILLQAIVLAAVFTLVLQFYLARILATERQYHSQIEASKAYLTAQLAYKTIEGDSISGKCYFTGGYASYLQEGNYLQVKVTLDKGGNYNHKFYRKTDTLQVPLKSNDNKASHKH

SEQ ID NO: 9053 - DNA, 201 bp, Streptococcus agalactiae
atggcattattttttaccttcctaaaggtatctcaagtcattttcttagtattattgattgcctatgccagctttttagtgatttcattagtcattggaggtgttcatctctatgaaaaaaatgagcgcaaaaaaagtttaactagaaataaagaaaaaattccaatttcaattattagacttcctgcgaaactaaaatcc

SEQ ID NO: 9054 - protein, 67 aa, Streptococcus agalactiae
MALFFTFLKVSQVIFLVLLIAYASFLVISLVIGGVHLYEKNERKKSLTRNKEKIPISIIRLPAKLKS

SEQ ID NO: 9055 - DNA, 249 bp, Streptococcus agalactiae
atgataatattcttatacgcttgtctgatgatatttgggatactttatattattgaacgtcgggtaagtcagaaaaagtctaaagttattttggaattattgatgaaccctaaacttcatttggatttattatcggcattaaaaccatttgaaaaagaaacagatcgtctcatataccttcgtaaaacttatcacctagatattattgatgctgttactttaaataatcaattgaaagagaaagaagta

SEQ ID NO: 9056 - protein, 83 aa, Streptococcus agalactiae
MIIFLYACLMIFGILYIIERRVSQKKSKVILELLMNPKLHLDLLSALKPFEKETDRLIYLRKTYHLDIIDAVTLNNQLKEKEV

SEQ ID NO: 9057 - DNA, 1671 bp, Streptococcus pyogenes
atggttttatcagatattgaaatagccaactctgtcactatggaacctatcagtaaggttgccgatcaattagggattgacaaggaggcgctctgtctctatggtaagtacaaggcaaaaattgatgcccgtcaactggtcgccttaaaaaacaaacctgatggcaaactcattcttgtcactgctatctcaccaacaccagctggtgaaggcaaaaccaccacttctgttggattggtagatgctctttctgccattggaaaaaaagcagttattgcccttcgtgaaccttctcttggtcctgtttttggggttaagggaggagctgctggcggtggccacgcgcaagttgtcccaatggaagacatcaaccttcactttacaggggactttcatgccatcggtgtcgccaacaacttattagctgccttgattgataaccacattcaccatggcaatagcctaggcattgattccagacgtatcacttggaaacgtgtggtggatatgaatgaccgccagcttcgtcatattgttgacggcttgcaaggcaaggtcaacgggattcctcgtgaagatggttatgacattaccgtcgcctctgaaatcatggcaatcctgtgcctatccgaaaatatttctgacctcaaagcccgccttgaaaaaatcatcatcggttacaactaccaaggtgaacctgtaacagctaaagacttgaaagctggtggtgccctagccgctctgctcaaggatgcgattcatcctaatctcgtgcaaaccctggaacacacaccagccctcattcacggtggcccatttgctaatatcgcccatggctgtaatagtgtcctcgccaccaaactagccttgaaatatggtgattatgccgttaccgaagctggatttggcgctgaccttggagctgaaaaattcattgacatcaaatgccgcatgtcaggccttcgcccagcagccgttgtcctagtagccactatacgtgcccttaaaatgcatgggggtgtgccaaaagcagacctggctactgaaaatgttcaggccgttgtggatggtttacctaaccttgacaaacatttggctaatatccaagacgtctatggccttccagttgtcgtggcgatcaataaattcccgcttgataccgatgccgaattacaagctgtctatgatgcctgcgacaaacgtggcgttgacgttgtgatttctgatgtttgggcaaatggcggagctggtggccgtgaactggctgaaaaagtcgtgacactagccgagcaagacaatcaattccgctttgtttatgaggaagacgatagcattgaaaccaaactgactaaaatcgttaccaaagtttacggtggtaaaggcatcaacttgagctcagcagccaaacgtgaactggctgacttagaacgcctcggctttggcaactacccaatttgcatggccaaaacccaatattccttctcagacgatgccaaaaaacttggcgcaccaactgactttacagtgactattagcaaccttaaagtgtccgcaggagcaggatttatcgttgccctaacaggtgctatcatgaccatgcctggccttccaaaagtacctgccagcgaaacaattgatattgacgaggagggcaacatcacaggactattc

SEQ ID NO: 9058 - protein, 557 aa, Streptococcus pyogenes
MVLSDIEIANSVTMEPISKVADQLGIDKEALCLYGKYKAKIDARQLVALKNKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGIPREDGYDITVASEIMAILCLSENISDLKARLEKIIIGYNYQGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGGRELAEKVVTLAEQDNQFRFVYEEDDSIETKLTKIVTKVYGGKGINLSSAAKRELADLERLGFGNYPICMAKTQYSFSDDAKKLGAPTDFTVTISNLKVSAGAGFIVALTGAIMTMPGLPKVPASETIDIDEEGNITGLF

SEQ ID NO: 9059 - DNA, 1908 bp, Streptococcus pyogenes
atgagtagagatccaacgttgacattagacgagtcaaatctcgttattggtaaggatggacgtgtgcattatacatttactgctagtcaagacaaccaaacagttagactagccagcaactgcttaggcacagcgcactttaatcagctcatgattgagcgaggggataaagcgactggctatgtggcgcctgtggttgttgagggtagcggtgagttgacaggtgtgtttaaaagtcttgaggagatgcttagtagcttgagatctattaatttagagctgacagacaccaaagactctaagctttggtcaaaaatcaagttgactaaccgtggcatgttgcaggagtactatgacggtaagatcaagactgagatagtcaactccgcacaaggtgtggctactcgtatcacagaggagactggcaaaaagctagcacttatcaatgagtctatcaacggtataaggcgagagtatcaaaacgctgataaaaagctatcagctagctatcagctgggcatagatggtctcaaagccaccatgcgtagtgataaaatcggcttacaagctgagatacaaacaaccgctcaaggcttgtatcaaaggtatgataacgagatacgcaagctgtccgctaaaataaccactacctcgtcaggcactacagaggcctatgaaagcaagctcgatggcttacgagctgagtttactcatagtaatcaaggtatgcgcgtagagctggagtcaaaaatcagtgggttgcaatcaacgcaacaagcaactgccaggcaaatctcacaagagataagtaaccgcgaaggtgctgtcagtcgtgtacaacagggcctagacagttaccaacgacgattacagtccgcagagggtaattacaatagtttgagagagactgtagcgggttatgagcgcaggatatccaatcaggataacactatctcctctaactttacacagctaaaaagcttgataaatcagtctgtgaccttaggaaaaatacagtccctcttgcggcaatctggcgacagtatcatgcttgcgattaaagacaaaatcccgcaaagtaaaatgtctggcagcgatattatctcagcgattaacttgaattcccgcggtgtgcaaatagctggtaaaaacatcgctcttgatggcaatacgacggttaatggagcttttggggctaagttaggggagtttatcaagctaagagccgaccagattatcggtgggacaatcgatgcaaacaaaatcaatgtgattaatctcaaagctagcagtattgttggtttagacgctaattttatcaaggcaagaattagctatgctatcactgatttgcttgagggtaaagttattaaggctcgtaatggtgcgatgacaatagacttgcaaagcggtcaaatcaaccattacacaaatgagtcagccatgagacgtatcgatagcagtacagctagtcagtttataaagatgacaaagtcaggctttatatctgagataggtaacatgcaagctgcaatgacggttataggctctaatagcgatgggtcagaaaaccatgaaaataaaaccttcggaggcataagaatttggaacgggaagtcatcttatcaatcgacaagttttgttgaattagttggtaaccgtgtagcaatctatggaaataaaaatcgtagtccatggctctttgactcaacaacgtcaggatatgcttaccttatccctcaaaatgacagaggtataaagcatgtcatagggagagctgatcgtaagatagaccaaatccacgttggagatatctatgtgcaaggcgaacgtgtagccatgatgttaaaagatttagcacttaaaattggctatataggtacaggtggttgggctaaccgcatagga

SEQ ID NO: 9060 - protein, 636 aa, Streptococcus pyogenes
MSRDPTLTLDESNLVIGKDGRVHYTFTASQDNQTVRLASNCLGTAHFNQLMIERGDKATGYVAPVVVEGSGELTGVFKSLEEMLSSLRSINLELTDTKDSKLWSKIKLTNRGMLQEYYDGKIKTEIVNSAQGVATRITEETGKKLALINESINGIRREYQNADKKLSASYQLGIDGLKATMRSDKIGLQAEIQTTAQGLYQRYDNEIRKLSAKITTTSSGTTEAYESKLDGLRAEFTHSNQGMRVELESKISGLQSTQQATARQISQEISNREGAVSRVQQGLDSYQRRLQSAEGNYNSLRETVAGYERRISNQDNTISSNFTQLKSLINQSVTLGKIQSLLRQSGDSIMLAIKDKIPQSKMSGSDIISAINLNSRGVQIAGKNIALDGNTTVNGAFGAKLGEFIKLRADQIIGGTIDANKINVINLKASSIVGLDANFIKARISYAITDLLEGKVIKARNGAMTIDLQSGQINHYTNESAMRRIDSSTASQFIKMTKSGFISEIGNMQAAMTVIGSNSDGSENHENKTFGGIRIWNGKSSYQSTSFVELVGNRVAIYGNKNRSPWLFDSTTSGYAYLIPQNDRGIKHVIGRADRKIDQIHVGDIYVQGERVAMMLKDLALKIGYIGTGGWANRIG

SEQ ID NO: 9061 - DNA, 1041 bp, Streptococcus pyogenes
atgaacaaaaaagtaatgtcacttggtcttgtttcgactgccctattcacattaggaggctgtaccaataactccgctaaacaaacaactgacaattcattaaaaatcgctatgattactaatcagacgggtattgatgacaagtcatttaaccagtcagcctgggaaggcttacaagcttggggaaaagaaaataaacttgaaaaaggaaaaggctatgattatttccaatcagccaatgaatcagagtttaccacaaaccttgagtcagcagtaaccaatggttataatcttgtttttgggattggatttccattacatgacgctgtagaaaaagtagccgcaaacaatcctgacaaccattttgcaattgtggatgatgtgattaaaggtcaaaaaaatgttgcaagtatcaccttttcagaccatgaagcggcatacctagccggtgttgcagcagctaaaacgacaaaaaccaagcaagttggttttgtaggtggtatggaaggagatgttgtcaagcgctttgaaaaaggttttgaagctggtgtgaaatcagtagatgataccatcaaagtaagagttgcttatgcaggctcttttgcagatgctgccaaaggcaagacgattgcagctgctcaatacgctgaaggcgcagatgttatttatcatgcagcaggaggcacaggggcgggtgtctttagcgaagctaagtctatcaacgaaaaacgtaaagaagaagataaggtttgggttattggtgttgaccgtgaccaaagtgaagatggaaaatacactacaaaagatggcaagtcagctaattttgttttgacctcaagtatcaaggaagtcggaaaagctttagtaaaagtagccgtaaaaacctcagaagaccaattcccaggtggtcaaataaccacttttggtttaaaagaaggtggtgttagccttacaacggatgctctgacacaagacactaaaaaagctattgaggctgctaaaaaagcgattatcgaaggaaccatcacagttcctgaaaac

SEQ ID NO: 9062 - protein, 347 aa, Streptococcus pyogenes
MNKKVMSLGLVSTALFTLGGCTNNSAKQTTDNSLKIAMITNQTGIDDKSFNQSAWEGLQAWGKENKLEKGKGYDYFQSANESEFTTNLESAVTNGYNLVFGIGFPLHDAVEKVAANNPDNHFAIVDDVIKGQKNVASITFSDHEAAYLAGVAAAKTTKTKQVGFVGGMEGDVVKRFEKGFEAGVKSVDDTIKVRVAYAGSFADAAKGKTIAAAQYAEGADVIYHAAGGTGAGVFSEAKSINEKRKEEDKVWVIGVDRDQSEDGKYTTKDGKSANFVLTSSIKEVGKALVKVAVKTSEDQFPGGQITTFGLKEGGVSLTTDALTQDTKKAIEAAKKAIIEGTITVPEN

SEQ ID NO: 9063 - DNA, 777 bp, Streptococcus pyogenes
atgacacatactaaagaagttgcatttatcactggtgctgcaagcggaattggaaaacaaatcggggaaaccttattaaaagaaggtaaaacggttgttttttccgacattaatcaagaaaaactggatcaggttgttgctgactatactaaagaaggctatgacgcttttagtgttgtgtgcgatgtcaccaaagaagaagccatcaatgctgctattgatacggttgttgaaaaatatggtcgtattgatattttggttaacaacgcaggtcttcaacatgttgccatgattgaagattttccaactgaaaaatttgaattcatgattaaaatcatgttgacagcaccatttattgccattaaacgtgcttttcctacaatgaaagctcaaaaacacggtcgtattattaatatggcttctatcaatggtgtcattggttttgctggcaaatccgcctacaattcagctaagcacggcttgatcggtctgaccaaagtaactgccttagaagctgctgattcaggcattacggtcaatgccatttgtcctggatatgttgacacaccactggttcgtggccagtttgaagacctttccaaaacaagaggtattccccttgaaaatgttcttgaagaagtgctatacccacttgttcctcaaaaacgcctcattgacgttcaagaaattgcagactatgtgtctttccttgccagtgataaggcaaaaggtgttacaggtcaagcctgtatcttagacggtggctacactgctcaa

SEQ ID NO: 9064 - protein, 259 aa, Streptococcus pyogenes
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYPLVPQKRLIDVQEIADYVSFLASDKAKGVTGQACILDGGYTAQ

SEQ ID NO: 9065 - DNA, 1359 bp, Streptococcus pyogenes
ttggttataaatgggatgtttaaaaaatattcaataaaaaatcgtgtttggcgcgccgtcgttgaaattgtctttggagtttgtatcactgttttaatgattgcgataatatcgctttctttttcaaagttaaatatagtgacatctcataatgtgggagaagaattttatattaaagataaacagtcaatcaaacagttgaacaattatatgaagacattgggattagattatgttgtttttgatagaaaaacagataaagctatggaaggaaaatatttatctaaagaattttctttatttaacgaagttgcagaagaaaaaaataatctgacttttaattctgtacattatgatttatatactaatatcaattataatattgttataagatataatgagataccggagttctctaaccattaccttagaaatgtttcatataacatgttgacattttatattctgggaataggaacgagtatcagcattgtagttgctttaacacggtttgtaaaagaaatttctttgaatttcaaggaaatcaagaagttagcaaataaaatggggatagaagtcctttctgaaaatgaaaattattctcaaataatcgagtttgatgatatacttagaactttacatattaaaggtgataatttgaaaagtttgattgagcgagaaatattggaaaagcaagatctatcctttcaaattgcagcactttcgcatgatattaaaacacctttaacggttttaaaaggaaatcttgagttattagaattgactactttaaataaaaatcaggaaggttatattgtatctatgaacaatagtatttctgtttttgaaggctatttcaattctttaatatcttatacacgcatgctttcagaggatagatcagtgaaactaattttagttgaggagctattaagtgagttacattttgaagtcgatgacttattgaatatcaataatattgaattttctatttgtaatagacttattatcacttctttttatggagatgaggaaaatctgataagagctctttctaaccttttagttaatgcaataagatttatgcccgtattagataaaaaaatcgaagttatactgtctgagtcaggagagcaaattcattttgaaatatggaataatggtgagcgtttcagtgatagtacactgaaaaagggagataaattattttacacggaagattatagcagaggtaacaaacattatggaatcggtttggcatttgttaaaggcgttgctatcaaacacggtgggaatcttcaattgaataatccagctagaggaggtgctagcgccataatctcgataaaaaagaaaatt

SEQ ID NO: 9066 - protein, 453 aa, Streptococcus pyogenes
LVINGMFKKYSIKNRVWRAVVEIVFGVCITVLMIAIISLSFSKLNIVTSHNVGEEFYIKDKQSIKQLNNYMKTLGLDYVVFDRKTDKAMEGKYLSKEFSLFNEVAEEKNNLTFNSVHYDLYTNINYNIVIRYNEIPEFSNHYLRNVSYNMLTFYILGIGTSISIVVALTRFVKEISLNFKEIKKLANKMGIEVLSENENYSQIIEFDDILRTLHIKGDNLKSLIEREILEKQDLSFQIAALSHDIKTPLTVLKGNLELLELTTLNKNQEGYIVSMNNSISVFEGYFNSLISYTRMLSEDRSVKLILVEELLSELHFEVDDLLNINNIEFSICNRLIITSFYGDEENLIRALSNLLVNAIRFMPVLDKKIEVILSESGEQIHFEIWNNGERFSDSTLKKGDKLFYTEDYSRGNKHYGIGLAFVKGVAIKHGGNLQLNNPARGGASAIISIKKKI

SEQ ID NO: 9067 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttggctttcgttggcaagtagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccatccctcagctattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcacagtattatcagactgttgaaaaatctaggggacagattgaagttagagaatactgggtgtcttccgatatcaaatggttgtgtcaaaattatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 9068 - protein, 380 aa, Streptococcus agalactiae
VTTMIDFIISIDDCAVELDSRQSWKIRYPLSTILFLGFRWQVAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNYPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 9069 - DNA, 1512 bp, Streptococcus pyogenes
ttgaggacaactatgaaaaaatatattttaaaccgtatcatgcgatcgttagtgtcggtagttctggtaacggctttaacatacaccatcgtatatactctagtacctaccagccttatctttaaacaagaccctaattataataaaatgacaacaacaccagataaaaaagtagcgtatgaaaatctaacttttcaacgtatgggttatgtcaattatttttcaagcaaagaattaaaagataatgcttctaaagtagatagtagtgtaacgacagaagcaactagtgctaacaaagctatctatgagaagtatattgattctcttggcaatggctggcagctaaaacgcttccccactagcaaacagttttatgcaattcgcaatattcctatttacgaacgtgtttggaactttttctcaaatctagttgttattgatcacccttggaagattcaggataaagataatccaaaattagctaggtatattcgtctagaaaaagataaatcagttggctggtcacttgttggttcggggacaaaacataagtatctcctctatactaacggaaaatttccttatcttcaccaaaactttgttaccttaaacttagggacatcttatccaacatacagcaatattcctgttcttcaggtcatttcacaagggcaaggacgaacagctcttcaagatgtgaccttcccatcaggtgtcactaagaaatcgtcagtggatatctatagccgtagctacaaaaatccaaaatcattggatgatatcaccaaggtaaactatggtaagggagattcctacactaaaaccatcaataattatgtcgacccatcaatgattcacaattcttttgtaattggtttttttggtgttatgttttcctatatcgttggtttgcctcttggtttatttatggctcggtttaaaaatacctattttgacagtttctcaacagcgaccatgaccttcatgcttgctttaccaagtattgctgttatctatgttgttcgcttcctaggtggcatggttggtttaccagatagtttcccaatgctgggggcatctgatcctaaatcttatattttaccagcccttattttaggaattttaaatattccaactacggttatctggttccgtcgctatcttgttgaccttcaggccagcgattgggtacgttttgcgcgttcaaaaggattatcagaatctgaaatttacagagggcatctcttcaaaaatgccatggtcccaattgtgtcaggggttcctgcaagtattatccttgctattggtggtgcaacattaacagagactgtctttgccttcccgggtatgggtaaaatgttaattgattctattaaatctgctaacaattctatgattgttggattaacctttatcttcactgtcttgtcaattgtttcacttttactaggagatattgtcatgacccttgtcgatccacgtattaaattgtcaacaaaaaaaggaggtaag

SEQ ID NO: 9070 - protein, 504 aa, Streptococcus pyogenes
LRTTMKKYILNRIMRSLVSVVLVTALTYTIVYTLVPTSLIFKQDPNYNKMTTTPDKKVAYENLTFQRMGYVNYFSSKELKDNASKVDSSVTTEATSANKAIYEKYIDSLGNGWQLKRFPTSKQFYAIRNIPIYERVWNFFSNLVVIDHPWKIQDKDNPKLARYIRLEKDKSVGWSLVGSGTKHKYLLYTNGKFPYLHQNFVTLNLGTSYPTYSNIPVLQVISQGQGRTALQDVTFPSGVTKKSSVDIYSRSYKNPKSLDDITKVNYGKGDSYTKTINNYVDPSMIHNSFVIGFFGVMFSYIVGLPLGLFMARFKNTYFDSFSTATMTFMLALPSIAVIYVVRFLGGMVGLPDSFPMLGASDPKSYILPALILGILNIPTTVIWFRRYLVDLQASDWVRFARSKGLSESEIYRGHLFKNAMVPIVSGVPASIILAIGGATLTETVFAFPGMGKMLIDSIKSANNSMIVGLTFIFTVLSIVSLLLGDIVMTLVDPRIKLSTKKGGK

SEQ ID NO: 9071 - DNA, 810 bp, Streptococcus pyogenes
atgaattttaaaaaaataagatttggttttttgctttgcctcctactttatcctttagcagcttgtaacaagtctgaacaacttaatcactacgaaagaattaaaaaaacaagaaaattagtcgttgctgtaagccctgattatgctccttttgaatttaaagctttagttaatggaaaagatactattgttggagcagatgttcaattagctcaggctattgctgatgaattagacgttgatcttgagctttcaccaatgagttttgataatgttttgtctagtttacagactggtaaagctgatcttgctatttcaggaatctcacatactaaagaaagagctaaagtatatgatttttcaattccttactatcaggcagaaaacgctatagtgatgagagcatctgatgctaaagtgaccaaaaatattagtgacctaaacggtaagaaagtagccgctcaaaaaggtagtatcgaggaaggtttagttaaaatacaattaccaaaggccaatctgatttctttgactgctatgggagaagccattaatgaactaaaagcaggacaagtctatgcagttaccttagaagcacctgtagctgctggttttttagcccaacataaggatctggctttagcaccctttagcttaaaaaccagtgatggagatgccaaagcagtggcccttcctaaaaatagtggagacttaaccaaagccgttaataaggttattgctaagttagatgagcaagaacggtacaagtcatttattgcagagacaatagcactaacgaaaaatactatgaag

SEQ ID NO: 9072 - protein, 270 aa, Streptococcus pyogenes
MNFKKIRFGFLLCLLLYPLAACNKSEQLNHYERIKKTRKLVVAVSPDYAPFEFKALVNGKDTIVGADVQLAQAIADELDVDLELSPMSFDNVLSSLQTGKADLAISGISHTKERAKVYDFSIPYYQAENAIVMRASDAKVTKNISDLNGKKVAAQKGSIEEGLVKIQLPKANLISLTAMGEAINELKAGQVYAVTLEAPVAAGFLAQHKDLALAPFSLKTSDGDAKAVALPKNSGDLTKAVNKVIAKLDEQERYKSFIAETIALTKNTMK

SEQ ID NO: 9073 - DNA, 597 bp, Streptococcus pyogenes
ttgaaggtgaaaaaaaggagaagaagggctaaatcatcagtaaatcgacttgtcttagggttagtattacttaatctgattgttagtatgtggacactaaaattgggaaaccagcgattagctccgtatgcggatcacgaaactctgacatttgtcaggaagattagtcatgctgctcaatcagtcgctcaaaagaaacagttatatagttcggtgatgatggctcaggccattttagaatccaataatggtaagtcacaactaagtcaaaaaccttattataattttttcgggattaaggggagctataaagaacggtcagtcatttttccaactttagaagacgatggacaagggaatctttatcaaattgatgctgcttttcgttcctatgggagcctgacagcttgttttttagattacgcaagagttttgaatgatccactttatgacaaaacccacaaaaagttttggtctcattatcaagatgctactgcaaccttaacaggcacttacgccactgatacaacttaccataccaaattaaatgaattgattgaatggtatcaactcactaattttgatggtctaatgaaa

SEQ ID NO: 9074 - protein, 199 aa, Streptococcus pyogenes
LKVKKRRRRAKSSVNRLVLGLVLLNLIVSMWTLKLGNQRLAPYADHETLTFVRKISHAAQSVAQKKQLYSSVMMAQAILESNNGKSQLSQKPYYNFFGIKGSYKERSVIFPTLEDDGQGNLYQIDAAFRSYGSLTACFLDYARVLNDPLYDKTHKKFWSHYQDATATLTGTYATDTTYHTKLNELIEWYQLTNFDGLMK

SEQ ID NO: 9075 - DNA, 1200 bp, Streptococcus pyogenes
atgacctttttagataaaattaaacaaggctgtttagatggctgggctaagtacaaaatcttgccatccttgaccgcagcacaagctatcttagagagcgggtggggcaaacatgccccacacaacgctctgtttggtattaaggcagatagctcttggactggtaaatcatttgataccaaaacccaagaggaatatcaagcaggtgttgtcacggatattgtggaccgatttagggcgtatgatagttgggatgagtcgatagctgatcacggacaatttttagttgataatccacgctatgaggcagttattggggagactgactataaaaaggcttgttacgctattaaagcagctggatacgctacggcaagtagctatgtcgaacttttaatccaactgattgaggaaaacgacttacaaagttgggatagagaagctcttaaaaataataaggaggaaacgatgacaaccgcaaacgaaattgtacaatactgtgttaaccttgctaattcaggcatgggtgttgacaaagacggtgctcacgggacgcaatgctgtgacttgccttgttttgtcgctaaaaattggtttggtgttgatctttggggcaatgcgattgatttattagacagcgcaagtgcgcaaggctgggaagtccatcgtatgccaacagaggcaaacccaaaagcaggcgctacatttgtccaatcagtgccgtatcatcaatttggacatacgggaattgttatcgaggatagtgacggttacaccatgcgcactgtcgagcaaaacattgatggcaatcctgatgctttgtatgtcggtgcaccagctcgttttaacactcgtgactttactggcgtgataggttggttttacccaccatatcaaggggatacagtcacgcaaccagtcagcaccgagccgcaaacttctgacactatcgtagagacagcaaaaacaggcacctttacccttgatgttgcagagatcaatatcagacgctggccaagtctagccagcgaggttgtaggtatctacaagcaaggtgatactgtcagctttgatagcgagggctacgctaatggctattattggattagctatgttggaggctcaggtatgcgtaactacctaggtattggacagactgataaagatgggaatcgcatcagcctttggggtaaattaaat

SEQ ID NO: 9076 - protein, 400 aa, Streptococcus pyogenes
MTFLDKIKQGCLDGWAKYKILPSLTAAQAILESGWGKHAPHNALFGIKADSSWTGKSFDTKTQEEYQAGVVTDIVDRFRAYDSWDESIADHGQFLVDNPRYEAVIGETDYKKACYAIKAAGYATASSYVELLIQLIEENDLQSWDREALKNNKEETMTTANEIVQYCVNLANSGMGVDKDGAHGTQCCDLPCFVAKNWFGVDLWGNAIDLLDSASAQGWEVHRMPTEANPKAGATFVQSVPYHQFGHTGIVIEDSDGYTMRTVEQNIDGNPDALYVGAPARFNTRDFTGVIGWFYPPYQGDTVTQPVSTEPQTSDTIVETAKTGTFTLDVAEINIRRWPSLASEVVGIYKQGDTVSFDSEGYANGYYWISYVGGSGMRNYLGIGQTDKDGNRISLWGKLN

SEQ ID NO: 9077 - DNA, 444 bp, Streptococcus pyogenes
ttgataatggaagaaatcacgatttatcataatccaaactgtggcacttcacgtaatgttcttgccatgattcgccatgcaggtattgagcctactattattgagtatttgcagacgccacctaatcgggagactttaattgagctcttacaatcgatgggaatctctgcaagagaactcttgcgaaccaatgttcctgaatttgaggcttatggattagcaaatcaagcagtagctgagaaagacattattaatgccatgttggcggatccaattttgatcaatcgtcctattgttgtgactcgcaaaggagtaaaactttgccgtccttctgagaccttactggatattcttcctgttcccctgcctagtccttatattaaagaggatggcgagagtgtgaaccctattgaggtaaaaggagaaaaagatgtcattgatgac

SEQ ID NO: 9078 - protein, 148 aa, Streptococcus pyogenes
LIMEEITIYHNPNCGTSRNVLAMIRHAGIEPTIIEYLQTPPNRETLIELLQSMGISARELLRTNVPEFEAYGLANQAVAEKDIINAMLADPILINRPIVVTRKGVKLCRPSETLLDILPVPLPSPYIKEDGESVNPIEVKGEKDVIDD

SEQ ID NO: 9079 - DNA, 1458 bp, Streptococcus pyogenes
atgaaatttacaatcattactaactatgatacacttagtagaaaatcatttactatagaaggtgataacatgactatttttcgtaaaaaaaagaaatattccaataaaacagaaatgcaaaggcacttcaaagttattgatttagtttttttaggcctaggttcaatggttggaacaggtatctttacagttactggcataggcgctgctaagtatgcaggtcctgctttaacaatatcgattatcatttccgcgattgctattggaattttagccttattttatgcagaatttgcgtctcgtatgccttctaacggtggtgcttatagttatgtttatgcaaccttgggagagtttccagcatggcttgttggctggtatattattatggaatttttaacagctatatctagtgttgctgttggctggggaagttatttaaaaggattacttgccaattataatatagtattaccaaacgctttaaatggcacgttcaatcttaagaatggaacttacatagatattcttcctgttttagtgatgtttttcgtgacagggattgtcctaatgaattcgaaattagccctgagattcaatagttttttagttattttaaaattttcagcactggctttatttatctttgtaggcattttttttattgatcacaataattggtctcattttgctccatatggtgtaggacaaattactggaggtaaaacaggtatctttgctggtgcttctgttatgttctttgcatttttaggatttgaatctatttcaatggcagttgatgaagtgaaagaaccacaaaaaacaatccctaaaggcatcattttatctttgattattgtaacagcactctatatagttgtcaccactattttaacgggaattgtacactacactaaattaaatgttccagacgcggtggcttttgctttaagaaatattagactttattgggcagctgactatgtgtcgatagttgctattttgactcttattacggtatgtatttctatgacctatgcattagctagaacaatttacagtattagtagagatggtttattacctaaatcactttatactctcactaaaaaaaataaagtgcctcaaaatgctactcttgtcactggactacttgctatgatttgtgcgggaatatttcctttatcgagtctagcagagtttgttaatatttgtactttagcatatttaattattctgtcgggtgcaattattaaactcagaagaatagaaggagaaccaaaagcaaatgaatttaaaactcctctagtaccattcctaccaatgttggcaattatcatttgtctatcatttatgagccaatataaagcttttacttggattgcttttgctattgccacaattattggaacattaatctacttagcttatggttatactcattcaatagaaaataaa

SEQ ID NO: 9080 - protein, 486 aa, Streptococcus pyogenes
MKFTIITNYDTLSRKSFTIEGDNMTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 9081 - DNA, 1125 bp, Streptococcus pyogenes
atggttttatttcatttaatcaaaaaagaaagtttacagatttttagaaaccgaacagccttattgatgatggtgatttttccaattttgatgatcgttattttaagttttgcctttaaatcaagttttaatactgcgacaacagtccctaaattgaccattcgttaccaattagagggtgaaaaaacggattaccagaaaaattttcttgcttttttaaaagttttaaaccaaaaacttcatttagagactaaacctagtaattctcttgaaaaagatcgacaaagggtcagtgaaggagccttaacggctgttttagaagtgaagaagaatcagaccattaaggttattactaataatattaatcagcaaaatgcagatttgatcaatatgctagtaaaaaattatgttgataatgctaaaacttatgactcgatagcagctctttatcctcaacaattaaatcatatcagaaagcgaagtgtggactatgttaaggtcagttcaatacagacaagtaaaggaatgacatcagctgattattatgctatttccatgtttaccatgattactttttatagtatgatgtctgcgatgaaccttgttttgtcagatcgtcaacaacggattacaaatcgtattcacttaacaggagtttctccaagttttttggtctttgggaaattaataggtgctatgttagcaacaactgttcaattgagtcttttatacatttttacaaggtttgttttacgagttaattggggcactaatgagtggatgcttattggtataacagcctccttagtctatctctctgtagctataggtatcgggctaggtataagcattaaaaatgaggcttttttaacggttgcatccaatactattattcctatattcgcctttttaggaggcagttacgttccattgacaacattacacagctctattattaatcaattgtcgaatatatctcctattaaatgggttaatgatagtttgttctatcttatttttggtggtcaatataatccgattcctgtaactttgatcgttaatattagtatcggaacaatttttataatattggcattgataggtatgagaaagcaggtgacgaca

SEQ ID NO: 9082 - protein, 375 aa, Streptococcus pyogenes
MVLFHLIKKESLQIFRNRTALLMMVIFPILMIVILSFAFKSSFNTATTVPKLTIRYQLEGEKTDYQKNFLAFLKVLNQKLHLETKPSNSLEKDRQRVSEGALTAVLEVKKNQTIKVITNNINQQNADLINMLVKNYVDNAKTYDSIAALYPQQLNHIRKRSVDYVKVSSIQTSKGMTSADYYAISMFTMITFYSMMSAMNLVLSDRQQRITNRIHLTGVSPSFLVFGKLIGAMLATTVQLSLLYIFTRFVLRVNWGTNEWMLIGITASLVYLSVAIGIGLGISIKNEAFLTVASNTIIPIFAFLGGSYVPLTTLHSSIINQLSNISPIKWVNDSLFYLIFGGQYNPIPVTLIVNISIGTIFIILALIGMRKQVTT

SEQ ID NO: 9083 - DNA, 339 bp, Streptococcus pyogenes
atgacacagttattaaaacgatatcctattactattttccttttagggttaacaggcttaatttttatagcaatgcaagtggtatatggacatttagcaactggtgctcaagctatttatcaagttggaggtatgtttggattactagtaaaagcaatgccagaccagttgtggcgattggtgactccgatatttattcatatcggctttggtcatttttttgtcaatggattaacactatattttgttggtcaaatcgtcgaagacctctggggctcacgccttttttattactttatgttttatcaggtgttatgggcaatgcctttactttttggt

SEQ ID NO: 9084 - protein, 113 aa, Streptococcus pyogenes
MTQLLKRYPITIFLLGLTGLIFIAMQVVYGHLATGAQAIYQVGGMFGLLVKAMPDQLWRLVTPIFIHIGFGHFFVNGLTLYFVGQIVEDLWGSRLFYYFMFYQVLWAMPLLFG

SEQ ID NO: 9085 - DNA, 1203 bp, Streptococcus pyogenes
atgattaatagagaaattgcagtaaaagtacagcatgttagtaaaacgtttaaactgcctacagaagcaactaaaagttttcgcacgactctggttaatcgcctaagagggattaaaggatttactgaacaacatgtgctaaaagatattaactttgatgtttataaaggcgatttttttggaattgttgggcgtaacggctcaggaaaatcaacgctccttaaaattatttcccagatctatgttccagaaaaagggcaggttacagtagatgggaagatggtttcttttatagagcttggagtgggattcaatccagaattaacaggacgagaaaacgtctatatgaacggcgccatgctgggatttaccaaagacgaagttgatgatatgtacaatgatattgttgattttgcagagttgcatcattttatgaatcaaaaattaaaaaattattcttctggcatgcaggtacgtttagcattttcagtggctattaaagcccaaggtgacgttcttattttagatgaggtgcttgctgtaggagatgaagcttttcagcgaaaatgtaatgattattttatggaaagaaaagacagtggtaagacgactattttagtgacacatgatatgggagctgttaagaagtattgtaaccgtgcagttcttattgaagatggtcttgttaaagcatatggagaaccatttgatgttgctaatcagtatagtgtagataatacagagacagctgaggatgcaatgaatgctgaaaaaatatctgtatctgatattgccaaagatttgaaagtgtcattaatctcaaatccaagaataacaccaaatgacacaatcacatttgaagtttcttatgaagttttaaaagatgattttacctacattgccttttctttaacggatattgatagaaacatttgggtttacaacgacaattctttagattatccaacacaaggtataggtagaaaatgcatttcctaccaatgtcaactatctcaacttaatgatataaaactaaaattagaagtaactgtccgagataagaacggtcagatgctactcttttcaacagcagaacaatcaccccagatagtgattcaaagaaacgatattgatcaagatgatctgtcagctctagattcagcaagtggcttgtatcaacgtaatgggaagtgggtttttcat

SEQ ID NO: 9086 - protein, 401 aa, Streptococcus pyogenes
MINREIAVKVQHVSKTFKLPTEATKSFRTTLVNRLRGIKGFTEQHVLKDINFDVYKGDFFGIVGRNGSGKSTLLKIISQIYVPEKGQVTVDGKMVSFIELGVGFNPELTGRENVYMNGAMLGFTKDEVDDMYNDIVDFAELHHFMNQKLKNYSSGMQVRLAFSVAIKAQGDVLILDEVLAVGDEAFQRKCNDYFMERKDSGKTTILVTHDMGAVKKYCNRAVLIEDGLVKAYGEPFDVANQYSVDNTETAEDAMNAEKISVSDIAKDLKVSLISNPRITPNDTITFEVSYEVLKDDFTYIAFSLTDIDRNIWVYNDNSLDYPTQGIGRKCISYQCQLSQLNDIKLKLEVTVRDKNGQMLLFSTAEQSPQIVIQRNDIDQDDLSALDSASGLYQRNGKWVFH

SEQ ID NO: 9087 - DNA, 456 bp, Streptococcus pyogenes
atgcgcagtattatcagactgttgaaaaatctagaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggt

SEQ ID NO: 9088 - protein, 152 aa, Streptococcus pyogenes
MRSIIRLLKNLEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 9089 - DNA, 711 bp, Streptococcus pyogenes
gtgactacgatgattgattttattatttctattgatgattgcgcagttgaattggatagtcgtcaatcttggaaaattcgctaccccttatcaaccattctatttcttgtcttcgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccatccctcagctattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctagaagt

SEQ ID NO: 9090 - protein, 237 aa, Streptococcus pyogenes
VTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRS

SEQ ID NO: 9091 - DNA, 1341 bp, Streptococcus agalactiae
atgagaaacaaaaaagtaacattagctcatattgtcgcaaagacaagtgttgctattgctttggctggagcaatgggtagcagtttattagctaatagcacaacgtacgctgttagtggcaaagaaaataaaaaaagcgatgtcaaatatgaaacgaccaaagttatggaagctaacgcaacttcctctaaagaagacaatcatgtcatgcacacattagacggctcaatgagtactgtctgggaggaaaattcacctggtggtggtgttggtgaagtactttcctacaagtttgcgtccccgatgcatattgggagaattttaattgttaatggagatacatctagcaaggagaattactacaagaaaaatagaattgcaaaggctgatgttaaatactataacaggaataaattggtcctctttcaaaaaattgaattaggcgacacctacactaaaaaaccgcatcacattgagattgataaaaaattagatgttgatcgtattgatattgaggtaacagaggtccatcagggacaaaacaaggatattttagccttgtcagaggtcacttttggcaatatagaacgcgatatttttgaaaaaaagtttaaagaaattaaagataaatgggtaacagataaacaagcagatgagtttattgaaactgccgacaagtatgctgataaagctgttcagatgtctgctgttgcgtcacgtgctgagtattatcggatgtacgttagccgcaaataccactacaaaaaagagtttgttgaaaaactaaaacaagtctacaaagaaagcggagcttcccacgttacaagcaaaaaagatgtgatgttagcttttgacgatgctaaaaaaaagtcaacgattggtcgacaagaaaacggtctttttgtgacaagttttgctgaggatatggctttgctctttactgatcaaggtaagttaaaatcagctgaccaaattgaaaatataaaagatgtcgatagcggaaaatatagcgatggggtttatcaatatgagtacgattctgaactaacaaaaaacattgataagctaggctatatccgaacagctagcggagatactcctggagcaaattcgctcaacgttcctggttgccaaacgtggtcaggaaaacacattgaaaattcagaaagtgaattaattttcccatcgattagtgttaaagatctaaaatctaaagctgtcttagcagagattgatgccaaaggctattttgaaattattgatcctaccatcattgctccaaatggtgaccataaaaaagtaactggtcgcttcaaaattaagaaaatgcaagataggaag

SEQ ID NO: 9092 - protein, 447 aa, Streptococcus agalactiae
MRNKKVTLAHIVAKTSVAIALAGAMGSSLLANSTTYAVSGKENKKSDVKYETTKVMEANATSSKEDNHVMHTLDGSMSTVWEENSPGGGVGEVLSYKFASPMHIGRILIVNGDTSSKENYYKKNRIAKADVKYYNRNKLVLFQKIELGDTYTKKPHHIEIDKKLDVDRIDIEVTEVHQGQNKDILALSEVTFGNIERDIFEKKFKEIKDKWVTDKQADEFIETADKYADKAVQMSAVASRAEYYRMYVSRKYHYKKEFVEKLKQVYKESGASHVTSKKDVMLAFDDAKKKSTIGRQENGLFVTSFAEDMALLFTDQGKLKSADQIENIKDVDSGKYSDGVYQYEYDSELTKNIDKLGYIRTASGDTPGANSLNVPGCQTWSGKHIENSESELIFPSISVKDLKSKAVLAEIDAKGYFEIIDPTIIAPNGDHKKVTGRFKIKKMQDRK

SEQ ID NO: 9093 - DNA, 828 bp, Streptococcus agalactiae
atgcctaaaaaccaccgcctaattaccaaaatcgaagcatcattggaacatatgaccagtttagaaaaagggattgctcatttttttattacaaccgatctgacacctcaagagttgaccgcatccgagatagttaagcgactacacatctctcaagccgccttgactcgatttgcaaaaaaatgtggttttactggttatcgtgcttttgcctttgattaccttcacagtcttcaagaatcacaagagactttccaatctattcacttagaattgacaaagcgcgtgctgatggactacgacgctcttattaataaaacctatgagctcgttaatgaggaaaaattactgaacttagccaagctgatcgattcttctgagcgagtctatttctttggcaaaggatcttctggactagtagcaagagaaatgaagctacgctttatgcgacttggtttaatctgtgatgcttattcagacactgatggttttacttgggcaaatagcctcgtcaatgaaaattgccttgtttttggtttttctttatctggcaaaacaaactctgtcatcacagcacttcatcaagctagtcagcgaggagccaaaactgtcctcttaacaacagataatcaaaccgaatttgacgactccttagatattattcccgtatcatcaactcaccaactacattatgggaatcgtgtgtcaccacaatttcctcttcttattatgatggacattatttatgcttacgttttagcgattgacaaaccgcacaaagaaaaaatcttcaaaaacactattattgacaaagaaaataacgacctt

SEQ ID NO: 9094 - protein, 276 aa, Streptococcus agalactiae
MPKNHRLITKIEASLEHMTSLEKGIAHFFITTDLTPQELTASEIVKRLHISQAALTRFAKKCGFTGYRAFAFDYLHSLQESQETFQSIHLELTKRVLMDYDALINKTYELVNEEKLLNLAKLIDSSERVYFFGKGSSGLVAREMKLRFMRLGLICDAYSDTDGFTWANSLVNENCLVFGFSLSGKTNSVITALHQASQRGAKTVLLTTDNQTEFDDSLDIIPVSSTHQLHYGNRVSPQFPLLIMMDIIYAYVLAIDKPHKEKIFKNTIIDKENNDL

SEQ ID NO: 9095 - DNA, 1008 bp, Streptococcus pyogenes
atggtagttaaagttggtattaacggtttcggtcgtatcggacgtcttgcattccgccgtattcaaaacatcgaaggtgttgaagtaactcgtatcaatgaccttacagatccaaatatgcttgcacacttgttgaaatacgatacaactcaaggtcgttttgatggaacagttgaagttaaagaaggtggatttgaagtaaacggaaacttcatcaaagtttctgctgaacgtgatccagaaaacatcgactgggcaactgatggggttgaaatcgttcttgaagcaactggtttctttgctaaaaaagaagcagctgaaaaacacttacatgctaacggtgctaaaaaagttgttatcacagctcctggtggaaacgatgttaaaacagttgttttcaacactaaccacgacattcttgacggtactgaaacagttatctcaggtgcttcatgtactacaaactgtttagctcctatggctaaagctcttcacgatgcattcggtattcaaaaaggtcttatgactacaatccacgcttacactggtgaccaaatgatccttgacggaccacaccgtggtggtgaccttcgtcgtgcacgcgctggtgctgcaaatatcgttcctaactcaactggtgctgctaaagctatcggtcttgttatcccagaacttaacggtaaacttgacggtgctgcacaacgtgttcctgttccaactggatcagtaactgagttggttgtaactcttgacaaaaacgtttctgttgacgaaatcaacgctgctatgaaagctgcttcaaacgatagcttcggttacactgaagatccaatcgtttcttcagatatcgtaggcgtatcatacggttcattgtttgacgcaactcaaactaaagtaatggaagttgacggatcacaattggttaaagttgtatcatggtatgacaacgaaatgtcttacactgctcaacttgtacgtactcttgagtacttcgcaaaaattgctaaa

SEQ ID NO: 9096 - protein, 336 aa, Streptococcus pyogenes
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 9097 - DNA, 861 bp, Streptococcus pyogenes
atgaagaaatcagttacattactgtctatcggacttgccagccttttattggcagcatgtgcgccacatcaatctcaaaaatcaagttgggacactatcaaagaaaaaggggtgttaaaagtagctaccccaggaacctatcagccaacttctttttacaacgataataatgagttagtaggttacgaagtagatatggtcaaagaaatcggtaaacgacttaacattaaagtcaagtttgttgaaacaggatttgaccaagcctttacctcagttgatagtggtcgagtggatatttctttgaacaactttgacattaccccaaaacgtcagaaaaaatacaatatctctacgccttataaatacggggtaggaggcatgattgtccgtgctgatggcagctcaaacatagctaaaaaagatcttagcgactggaaaggaaaaaaagcagccggcgcttctggaacagaatacatgaaagtagcgcaaaaacagggagctgaactggtgacctacgataatgttacaggagatgtttatctaaacgatgtggctaacggtcgaacagatttcatcccaaatgattacccagctcaaaaattatttgtggattacatgttatctcaaaatccaaatctaaatgtcaaaatgagcgatgttcagtacaacccaaccgaacaaggaattgttatgaacaaaaaagacgatagcctcaagaaaaaaatagatgctgttattaaagacatgataaaagatggtagcttgaagaaaatctctgaaacctactatgctggtcaagatctgacaaaaccttttggcaaagacaaaaaaattcccgtcattgatacgaaagacgttaac

SEQ ID NO: 9098 - protein, 287 aa, Streptococcus pyogenes
MKKSVTLLSIGLASLLLAACAPHQSQKSSWDTIKEKGVLKVATPGTYQPTSFYNDNNELVGYEVDMVKEIGKRLNIKVKFVETGFDQAFTSVDSGRVDISLNNFDITPKRQKKYNISTPYKYGVGGMIVRADGSSNIAKKDLSDWKGKKAAGASGTEYMKVAQKQGAELVTYDNVTGDVYLNDVANGRTDFIPNDYPAQKLFVDYMLSQNPNLNVKMSDVQYNPTEQGIVMNKKDDSLKKKIDAVIKDMIKDGSLKKISETYYAGQDLTKPFGKDKKIPVIDTKDVN

SEQ ID NO: 9099 - DNA, 2415 bp, Streptococcus pyogenes
gtgaatacttatttttgcacacaccataaacaattactactttattcaaacctattccttagctttgctatgatgggccaaggaactgccatttatgccgatacactgacttcaaattcagaacctaataatacttactttcaaacgcaaacgctcactactacagatagcgaaaaaaaggtagtacagccacaacaaaaagactactatactgaattgttagaccaatggaacagtattatcgcaggcaacgatgcttatgataaaaccaatcctgacatggtcacttttcataataaagctgaaaaggatgctcaaaacattattaaaagctatcaagggcctgaccacgaaaatagaacttacctttgggaacatgcaaaggattattccgcttctgctaatatcacgaaaacttaccgcaatattgaaaaaatagcaaaacagatcactaatcctgaatcatgctattatcaagatagtaaagctattgctattgtaaaagacggtatggccttcatgtatgaacacgcttataatctagatcgtgaaaatcatcaaacaactggaaaagaaaacaaagaaaattggtgggtttatgaaattggaactcctcgtgctattaataataccttatccttgatgtatccttattttactcaagaagaaattcttaaatacacagctccaatcgaaaaatttgtgcctgaccctactcgttttagggttcgcgctgccaatttttcaccttttgaagccaatagcggaaatttaattgatatggggcgtgttaaactcatttccggtattcttcgtaaagatgatctcgaaattagtgatacaatcaaagcaattgagaaagttttcacgctagttgatgaaggaaatggtttttaccaagacggttctttaattgatcacgtggttactaacgctcaaagtccactttataaaaaaggcattgcttacactggagcttacggtaatgtgcttatagatggcttatcgcaattaattcctattattcaaaaaacaaagtctcctataaaagcggataaaatggctactatctatcattggattaaccattcttttttccctatcatcgttcgtggagaaatgatggatatgactcgagggcgttctatcagtcgttttaatgcccaatctcatgttgctggcattgaagcacttcgtgctattttacgtattgctgacatgtctgaagagcctcaccgtttggcacttaaaacacgtataaaaacactcgtcacacaagggaatgctttttacaatgtctatgataatttgaaaacctatcacgatatcaaacttatgaaagaactactaagtgatacttctgttccagtccaaaaacttgatagttacgtagctagtttcaatagtatggataaattggcactatataataataaacacgattttgcttttggcctatcaatgttttcgaatcgaactcaaaattatgaagctatgaataatgaaaatcttcatggctggtttacttctgatggaatgttttacctatacaataacgatttaggacactacagtgaaaactattgggcaacggtaaatccctaccgcttacctggaaccacagaaactgagcaaaaaccactagagggaactcctgagaatattaaaacgaactatcaacaagttggcatgactggtctctctgatgacgcttttgttgcaagtaaaaaacttaataacacaagtgctctagctgctatgaccttcactaattggaataaaagcctcaccctcaataaagggtggtttatcttaggaaacaaaataatctttgttggtagcaatatcaaaaaccaatcatctcacaaggcgtatacaactattgaacaacgaaaagaaaatcaaaagtacccttactgttcttatgttaacaatcaacccgttgacttgaataatcagctagttgattttacaaacactaaaagtattttccttgaaagtgatgatcccgctcaaaatattggttactacttcttcaagccaacaacacttagcataagtaaggcacttcaaacagggaaatggcaaaacataaaagctgatgacaaatcaccagaagccatcaaagaagtttcaaatacctttatcactatcatgcaaaaccatactcaagatggcgatcgttatgcctatatgatgcttccaaatatgactcgtcaagaatttgaaacctatattagcaagcttgatatcgacttattagaaaacaatgacaaactggccgctgtctacgatcatgatagtcaacagatgcacgtcattcactatggaaaaaaagcaacgatgttttcaaatcataatctttctcatcaaggcttttatagttttcctcatcctgtcaggcaaaatcaacaa

SEQ ID NO: 9100 - protein, 805 aa, Streptococcus pyogenes
VNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 9101 - DNA, 552 bp, Streptococcus pyogenes
atgctaaaacgccccattcatctctcgcatgattttttagcggaggttgtggataagtctagtgtggttgttgatgccacgatgggtaatggaaatgatactgcctttttggcacaattagctaaaaaggtttatgcttttgatgtgcaagaacaagctattagaaaaacaagtgagcggttagcgcagctaggattatcgaacgctgagctgattttagcgggtcatgaagcggttgatcagtatgtgacagagccggtgcgcgcagcgatttttaaccttggttatttgcccagcgcagataaatctattattaccttaccaaataccacactccaagctttatcaaaactactaacgttattaatggtaggtgggcgtattgctattatggtctattatgggcatgatggaggcagtttggaaaaagatgctttattagattttgtcaagcaattagaccaaagaaaggtttctgcaatgctttatcagcctcttaatcaggtgaataccccaccttttttaatcatgttggagaaattagcagacttt

SEQ ID NO: 9102 - protein, 184 aa, Streptococcus pyogenes
MLKRPIHLSHDFLAEVVDKSSVVVDATMGNGNDTAFLAQLAKKVYAFDVQEQAIRKTSERLAQLGLSNAELILAGHEAVDQYVTEPVRAAIFNLGYLPSADKSIITLPNTTLQALSKLLTLLMVGGRIAIMVYYGHDGGSLEKDALLDFVKQLDQRKVSAMLYQPLNQVNTPPFLIMLEKLADF

SEQ ID NO: 9103 - DNA, 933 bp, Streptococcus pyogenes
atgtcaaaaattttagtttttggtcatcaaaatcctgatacggatgctattgcatcatcttatgcttttgattacttatcccaaaaagcgtttggtttggatactgaagtcgtagctttaggaacacctaacgaagaaacagcttttgcccttgattattttggtgttgaggcaccacgtgtggtagagtctgctaaagcacaagggtctgaacaagtgattttgacagaccacaatgaattccaacaatccattgcagatatccgtgaggttgaggtatatggtgtggttgatcaccaccgtgtggctaattttgaaactgcaaatcctttatacatgcgtgtggaaccagtaggatcagcctcatctattgtttaccgtatgtttaaagaaaatggcatcgaggtgccaaaagcgattgcagggatgctcttgtctggtttgatttcagataccttgttgttgaaatctccaacaactcatgtgtctgatcaccttgtcgctgaagaattggcagagctggcagaagtgaacttggaagactatggaatggctcttttaaaagcaggtacaaaccttgcaagcaaatcagaagtagaattgattggtattgatgccaaaacatttgaattaaatggcaatgctgtgcgcgtggcacaagtgaacactgttgacattgcagaagtcttagaacgtcaagaagctattgaagcagccattaaagatgccatggctgcagaaggttattcagattttgttttgatgatcacggatattgttaactcaaactctgaaattctagctattggagcaaacatggacaaggttgaagcagcctttaacttcacccttgacaacaatcatgccttcttagcaggtgccgtttctcgtaaaaaacaagtggttccacaattgacagaaagttttggagct

SEQ ID NO: 9104 - protein, 311 aa, Streptococcus pyogenes
MSKILVFGHQNPDTDAIASSYAFDYLSQKAFGLDTEVVALGTPNEETAFALDYFGVEAPRVVESAKAQGSEQVILTDHNEFQQSIADIREVEVYGVVDHHRVANFETANPLYMRVEPVGSASSIVYRMFKENGIEVPKAIAGMLLSGLISDTLLLKSPTTHVSDHLVAEELAELAEVNLEDYGMALLKAGTNLASKSEVELIGIDAKTFELNGNAVRVAQVNTVDIAEVLERQEAIEAAIKDAMAAEGYSDFVLMITDIVNSNSEILAIGANMDKVEAAFNFTLDNNHAFLAGAVSRKKQVVPQLTESFGA

SEQ ID NO: 9105 - DNA, 750 bp, Streptococcus pyogenes
atgctaaaaaagcgctatcaactggctattgtccttcttcttagctgttttagtctgatctggcaaactgagggcttggtcgagctttttgtctgtgagcactatgagcgggcggtttgtgaggggacgcctgcttattttaccttttcggatcaaaagggcgctgagacactgattaaaaagcgatggggcaagggtctcatctacccaagggctgagcaagaggcgatggctgcttatacctgtcagcaggcaggccctatcaacaccagcctagacaaagccaaaggtgagctcagccaactcacgcctgagctaagggatcaggtggcccagctcgatgctgcgactcaccggctagtcatcccgtggaacattgtagtataccgctatgtatacgagacgtttttgcgtgatatcggtgtttcacatgctgatctcacgtcttactaccgtaaccatcagtttgaccctcatatcctttgtaagatcaagcttggtacacgctacaccaagcacagttttatgagcacgacagccttgaaaaacggcgccatgacccatcgaccggtggaggtgcgcatctgtgtcaaaaaaggggccaaggcagcctttgtcgagccttattcggctgtgccttcagaggttgagctcttgtttccaagaggctgtcagctggaggtcgttggagcttacgtgtcacaggaccaaaaaaagctccacatagaagcgtatttcaagggcagtttg

SEQ ID NO: 9106 - protein, 250 aa, Streptococcus pyogenes
MLKKRYQLAIVLLLSCFSLIWQTEGLVELFVCEHYERAVCEGTPAYFTFSDQKGAETLIKKRWGKGLIYPRAEQEAMAAYTCQQAGPINTSLDKAKGELSQLTPELRDQVAQLDAATHRLVIPWNIVVYRYVYETFLRDIGVSHADLTSYYRNHQFDPHILCKIKLGTRYTKHSFMSTTALKNGAMTHRPVEVRICVKKGAKAAFVEPYSAVPSEVELLFPRGCQLEVVGAYVSQDQKKLHIEAYFKGSL

SEQ ID NO: 9107 - DNA, 696 bp, Streptococcus pyogenes
atgactaaagttgttttagtgacgggctgtgctagtgggattggttatgcacaggcccgctattttttgaaacaagggcatcacgtatatggtgtggataagtcggataaaccggacttaagcggtaactttcactttatcaaattggatttatcctctgagttagccccactatttaaagtggtccccagtgttgatattttgtgtaatactgcagggattttagatgcctacaagccacttttagacgtcagtgatgaagaagtggaacacctatttgatattaatttttttgcgacggtgaagttaacacgtcattatcttagacgtatggtggaaaagcagtcaggtgttatcatcaatatgtgctcaatagcaagttttatagcgggtggcggtggtgttgcctatacgagttctaagcatgcccttgcgggattcacgcgccagctggctttggattacgccaaagatcagattcacatttttggtatagcaccaggtgctgtcaaaaccgctatgacggctaacgattttgagcctggtggcttagcagactgggtagctcgtgagacgccaattgggcgttggactaaaccagatgaagttgctgaattaacgggatttcttgcttcaggaaaagcgagatcaatgcaaggcgagattgtcaaaattgacggtggctggactttgaaa

SEQ ID NO: 9108 - protein, 232 aa, Streptococcus pyogenes
MTKVVLVTGCASGIGYAQARYFLKQGHHVYGVDKSDKPDLSGNFHFIKLDLSSELAPLFKVVPSVDILCNTAGILDAYKPLLDVSDEEVEHLFDINFFATVKLTRHYLRRMVEKQSGVIINMCSIASFIAGGGGVAYTSSKHALAGFTRQLALDYAKDQIHIFGIAPGAVKTAMTANDFEPGGLADWVARETPIGRWTKPDEVAELTGFLASGKARSMQGEIVKIDGGWTLK

SEQ ID NO: 9109 - DNA, 1770 bp, Streptococcus pyogenes
atgtattatactagtggtaattacgaagcttttgcaacacctcgaaaacccgaaggggtagatcagaaatcagcttatattgttggtactggtttagctggtttagcagcagctgttttccttattcgcgatgggcatatggctggggaacgcattcatctgtttgaggaattgcctttagcaggtggttctttagatggtattgaaaagcctcatcttggttttgtgacccgtggtggtcgtgagatggaaaatcattttgagtgtatgtgggacatgtatcggtctattccctcactggaaattcccggtgcgtcttatttagatgaattttattggttggataaggatgatcctaactcatccaactgtcgtttgattcacaagagaggaaatcgtgtggatgatgacggccagtatacgctcggtaaacagtcaaaagaattaatccatttaatcatgaagacagaagaatctctaggagaccaaaccattgaagagttcttctcagaagatttctttaagagtaatttttgggtgtattgggcaaccatgtttgcttttgaaaaatggcattctgctgtagaaatgcgacgctatgcgatgaggtttatccaccatattgatggtttgccagatttcacctccctcaagttcaacaaatataaccaatatgactctatggtcaaaccgattattgcttacctagaatcacacgacgttgacatccaatttgacacaaaagtcactgatattcaggtggagcaaacagctggtaaaaaggtagcaaaaaccatccatatgacggtgtctggggaggctaaggcgattgagctaacacctgatgatttggtttttgtgaccaatggttctattactgaaagcagcacatacggtagtcatcacgaagtggctaagccaaccaaagcgttaggtggttcttggaatttatgggaaaatctagctgctcaatcagatgattttggtcatcctaaagtgttttaccaggacttgcctgctgaaagctggtttgtgtctgctacagcaaccataaaacacccagctatcgagccttatatagaacgtttgacccaccgtgacttgcacgatggcaaagtgaacactggcggcatcatcactattacagattctaactggatgatgagctttgccattcaccgtcaacctcattttaaagaacaaaaagaaaatgagaccactgtctggatttacggtctttattccaatagtgagggcaattacgtccacaagaaaattgaggagtgtacaggtcaagaaatcacagaagaatggttgtaccaccttggggtacctgttgataaaatcaaggacttagcgagtcaggactatatcaatacagttcctgtttacatgccttatattacgagttactttatgccacgcgtcaaaggagaccgtccgaaagttatcccagatggttcagtcaacttggcctttattggtaactttgcggaatctccatctcgagatacggtctttacgactgagtattctattcgtactgccatggaagcagtgtatagcttcttgaatgtggaacgaggcatcccagaagtctttaattcagcctatgatattcgtgaattgctcaaagccttttattaccttaatgataaaaaggcaatcaaggatatggatttgccaattcctgcactgattgagaaaatcggacataaaaaaatcaaggatacctttatcgaagaattgctcaaagatgctaatcttatg

SEQ ID NO: 9110 - protein, 590 aa, Streptococcus pyogenes
MYYTSGNYEAFATPRKPEGVDQKSAYIVGTGLAGLAAAVFLIRDGHMAGERIHLFEELPLAGGSLDGIEKPHLGFVTRGGREMENHFECMWDMYRSIPSLEIPGASYLDEFYWLDKDDPNSSNCRLIHKRGNRVDDDGQYTLGKQSKELIHLIMKTEESLGDQTIEEFFSEDFFKSNFWVYWATMFAFEKWHSAVEMRRYAMRFIHHIDGLPDFTSLKFNKYNQYDSMVKPIIAYLESHDVDIQFDTKVTDIQVEQTAGKKVAKTIHMTVSGEAKAIELTPDDLVFVTNGSITESSTYGSHHEVAKPTKALGGSWNLWENLAAQSDDFGHPKVFYQDLPAESWFVSATATIKHPAIEPYIERLTHRDLHDGKVNTGGIITITDSNWMMSFAIHRQPHFKEQKENETTVWIYGLYSNSEGNYVHKKIEECTGQEITEEWLYHLGVPVDKIKDLASQDYINTVPVYMPYITSYFMPRVKGDRPKVIPDGSVNLAFIGNFAESPSRDTVFTTEYSIRTAMEAVYSFLNVERGIPEVFNSAYDIRELLKAFYYLNDKKAIKDMDLPIPALIEKIGHKKIKDTFIEELLKDANLM

SEQ ID NO: 9111 - DNA, 591 bp, Streptococcus pyogenes
atgattattggcatcacaggaggcattgcatcaggaaaatcgactgtggttaaggtcattagaaaagctggttatcaggtgattgatgcggatcaagtggtccatgacttgcaagaaaaaggcggtcgtctttacgaggctcttagagaagcttttgggaatcagattttaaaagcagatggtgagttagatcgcacaaagctgtcagaaatgcttttttcaaacccagataatatggcaacatcctcagccattcaaaatcaaatcattaaggaagaattggcggctaagcgtgaccacttagcacagagccaagccatttttttcatggatattccccttttaatggaattgggctaccaagactggtttgatgcgatttggctggtttatgtagatgctcagacacaattgcagcgcttaatggctagaaatcgtttagacaaaggaaaagcaaggcagcgaatagccagtcagttaccaatagaggaaaaaaagccctatgccagtctagtgattgataatagtggggatattgcagccttaataaagcaagtacaatctgcgttgttgttattagccaatccgagg

SEQ ID NO: 9112 - protein, 197 aa, Streptococcus pyogenes
MIIGITGGIASGKSTVVKVIRKAGYQVIDADQVVHDLQEKGGRLYEALREAFGNQILKADGELDRTKLSEMLFSNPDNMATSSAIQNQIIKEELAAKRDHLAQSQAIFFMDIPLLMELGYQDWFDAIWLVYVDAQTQLQRLMARNRLDKGKARQRIASQLPIEEKKPYASLVIDNSGDIAALIKQVQSALLLLANPR

SEQ ID NO: 9113 - DNA, 924 bp, Streptococcus pyogenes
atgacactactatctatcattgtcccctgctttaatgaagaagcaaacattctcccttattttgaagaaatgcatcaactagaaacgtccatgaccaaccaacttgcttttgaatacatttttattgatgatggttctaaggataacaccttgggtattttgcgtgagctagctgctcgctttccaaatgtgcattatctgtctttttcacgccattttggcaaggaagctgggctcttagctggactaaaagaagccaaaggcaattacattactgtgatggatgtggatctgcaagatccacccgaacttttgccaattatgtacgctaagctaaaagaaggttatgacatcgttggcaccaggcgccaaaatagacaaggagaaccactaattcgttcaatgtgttcgaatctattttatggactgatcaaacacttatcagatactgaaatggtcaatggagttcgggattatcggttaatgaccagacaagtcgttgatagcattcttgagttgggagaggttaatcgtttttcaaaagggatcttttcgtgggttggttatcgtatcacctatcttagttttgaaaaccaaaaacgcaaatatggaaaaagtcgttggcatttttgggagttgctccgatattctttagatggctttatcaacttttcagaaatgccgttaaccattgctacctggacagggactttcagctttttgatttctattttcgccatcttatttatcattatcagaaagatactctttggtgatcctgtctctggttgggccagcactgtctctattattttattcatgggaggcattcagctcttttgcatgggtattattggaaaatatatttcaaaaatattccttgaaactaaaaaaaggcctctctatattatcaaagaaaaacat

SEQ ID NO: 9114 - protein, 308 aa, Streptococcus pyogenes
MTLLSIIVPCFNEEANILPYFEEMHQLETSMTNQLAFEYIFIDDGSKDNTLGILRELAARFPNVHYLSFSRHFGKEAGLLAGLKEAKGNYITVMDVDLQDPPELLPIMYAKLKEGYDIVGTRRQNRQGEPLIRSMCSNLFYGLIKHLSDTEMVNGVRDYRLMTRQVVDSILELGEVNRFSKGIFSWVGYRITYLSFENQKRKYGKSRWHFWELLRYSLDGFINFSEMPLTIATWTGTFSFLISIFAILFIIIRKILFGDPVSGWASTVSIILFMGGIQLFCMGIIGKYISKIFLETKKRPLYIIKEKH

SEQ ID NO: 9115 - DNA, 813 bp, Streptococcus pyogenes
atgattcgctttttaattttagctggctattttgaactaaccatgtatctccagctgtctggcaaactggatcagtacatcaatgttcggtattcttaccttgcttatatttccatgattttatctttcattttagctcttgttcaactctatacctggatgaaaaacattaaggtacatagccatttaacaggaaaaatcgcaaggctgacgagtccttttatcttggtctttcctgttttgattggtctccttgtgccgaccgtgaccttagattccaccacggtttctgctaaaggctatactttcccattggctgcgggagcctctaaaacgggagtcagtgatgacggtaccaccattcaatacctcaaacctgataccagcctttactttacaaagtctgcctaccaaaaggagatgcgtcaagaactccataaatataaaggcaagaaaccggtcaccattaccactgaaaattatatggaagtgatggaattgatctatctctacccagatgagtttcttgatcgtgacatccaatacactggctttgtttataacgaaccgggccatgacaactaccaattccttttccgcttcggcattattcactgtattgccgactcaggagtgtacggacttttgaccacaggtaatcaaaccagctaccctaacaacacatggctaacagttaaaggtcgccttcatatggaatatgataaaaacttagaacaacatctacctgtccttcaacttgctgaggttcatcaaaccaaagaacctaataatccttatgtttaccgcgttttt

SEQ ID NO: 9116 - protein, 271 aa, Streptococcus pyogenes
MIRFLILAGYFELTMYLQLSGKLDQYINVRYSYLAYISMILSFILALVQLYTWMKNIKVHSHLTGKIARLTSPFILVFPVLIGLLVPTVTLDSTTVSAKGYTFPLAAGASKTGVSDDGTTIQYLKPDTSLYFTKSAYQKEMRQELHKYKGKKPVTITTENYMEVMELIYLYPDEFLDRDIQYTGFVYNEPGHDNYQFLFRFGIIHCIADSGVYGLLTTGNQTSYPNNTWLTVKGRLHMEYDKNLEQHLPVLQLAEVHQTKEPNNPYVYRVF

SEQ ID NO: 9117 - DNA, 426 bp, Streptococcus pyogenes
atgaataaaagtttcaaaaacttagtgattggagctgtttcaggagtagcggcagcttacttcttatcaacagaaaaaggcaaggctttgaaaaatcgtgctgaaaaagcttatcaagcctacaaagaaagtccagatgattaccaccaatttgctaaagaaaaaggtagtgaatacagccatttagcacgtgacactttctatgatgtgaaagataagttggcttctggtgacttaactaaagaggacatgttagacttgctcaaagataaaacaacagctttcgtgcaaaaaacaaaagaaacccttgccgaagttgaagcgaaagaaaagcaagatgatgttatcattgatttaaatgaagaagacatcatcattgactatactgaacaagatgagcctgttagtgatacactagataaacac

SEQ ID NO: 9118 - protein, 142 aa, Streptococcus pyogenes
MNKSFKNLVIGAVSGVAAAYFLSTEKGKALKNRAEKAYQAYKESPDDYHQFAKEKGSEYSHLARDTFYDVKDKLASGDLTKEDMLDLLKDKTTAFVQKTKETLAEVEAKEKQDDVIIDLNEEDIIIDYTEQDEPVSDTLDKH

SEQ ID NO: 9119 - DNA, 1248 bp, Streptococcus pyogenes
atgaaggaggaaaattttgaggcaagatgttataatagagaaaaaggagggtgtgtcttgattaaaactatgcaatacaaaaaaacgatggcaacagttgttgctcttatcgtcgcacttttgctatttggcttgatttatgatttacttggggttcaaaaaaatgagctagcagctcaaaaatctgctcagccaaaggtcaaaacagcgcgtgttgtagctaatggcgacattttaattcatgatattctctacatgagtgctagaaaagctgacgatacctatgatttcactccttattttgaatatgttaaggactggattagcggtgctgacttagctattggagattatgaagggaccattagcccagattatcccttagcaggctatcccttattcaatgctccagaagagattgcaggtgctctgaaaaatactggctatgatgtagtcgatttagcccataatcatatcttagattcccaattagacggtgcccttaacactaaaaaggtttttcatcaattaggtatagacagtattggcatctatgacaaggatcgttcaaaagaatccttcttaattaaaaatgtcaatggtatcaaaattgcaattttaggttattcttatggttataacggcatggaggccacacttagccaagaagactatgagaaacacatgtctgatttagatgaagctaagataaaaaaagaacttcagctagctgaaaaaaaggctgacgtgaccattgttatgccacaaatgggaacagaatatgccttagaaccgacagcagaacaaaaagaactttaccacaaaatgattgattggggagctgacgtcgtcctaggaggccatccgcatgttattgaaccttcagagacagttataaaaggtaggcaaaagaaattcattatttactctatgggaaattttatttcaaatcagcggcttgaaaccgtagatgatatctggactgagcgtggcctattgatggaccttacttttgagaaaaaagataacaaaacaaaaattaaaacagttgaggcccatccaaccatggttttagccaaaggtaaaggcattgtgggtaaagaaggttttgaactatacaattatcgaacaatggttttagaagattttatcaaaggtggaaaataccacgacaagattgatgaggaaaccaaagcaaaagtagcacttgcctatcaggaaattaatgatttagttaacctgaaatgg

SEQ ID NO: 9120 - protein, 416 aa, Streptococcus pyogenes
MKEENFEARCYNREKGGCVLIKTMQYKKTMATVVALIVALLLFGLIYDLLGVQKNELAAQKSAQPKVKTARVVANGDILIHDILYMSARKADDTYDFTPYFEYVKDWISGADLAIGDYEGTISPDYPLAGYPLFNAPEEIAGALKNTGYDVVDLAHNHILDSQLDGALNTKKVFHQLGIDSIGIYDKDRSKESFLIKNVNGIKIAILGYSYGYNGMEATLSQEDYEKHMSDLDEAKIKKELQLAEKKADVTIVMPQMGTEYALEPTAEQKELYHKMIDWGADVVLGGHPHVIEPSETVIKGRQKKFIIYSMGNFISNQRLETVDDIWTERGLLMDLTFEKKDNKTKIKTVEAHPTMVLAKGKGIVGKEGFELYNYRTMVLEDFIKGGKYHDKIDEETKAKVALAYQEINDLVNLKW

SEQ ID NO: 9121 - DNA, 619 bp, Streptococcus pyogenes
atgtatgggaaatattgccttagtaacaggggcttcagccggttttggcagagccattgtcgaacacttaattgcagatgggataaaggttattggtgcttctcgtcgtcttgagaaactcaaggccttagaaacgagctttgggtcggacaacttttaccctttgcagatggatgtcacagataccaaagcgattgatgatgctttgacaagtctaccaaatcagtggcaagatattactattttagtgaataatgcaggcttggcattaggacttgataaggcttatgaagccgattttgagaattggatgacgatgattaataccaatattgttgggttgatttatctcacacgtcaattattaccacatatggtctccaaagatgatggtattattattaatttagggtcaaccgcagggacaattccctatccgggagctaatatttatggggctagcaaggcttttgttaagcagttctcactcaatttacgagctgatttagcaggtagccatatacgtgtgaccaatattgaacccggtctatgtgaagggacagaattttcaaagggacagaattttcaaaggtccgctttaatggtgatgaggaacggg

SEQ ID NO: 9122 - protein, 205 aa, Streptococcus pyogenes
MGNIALVTGASAGFGRAIVEHLIADGIKVIGASRRLEKLKALETSFGSDNFYPLQMDVTDTKAIDDALTSLPNQWQDITILVNNAGLALGLDKAYEADFENWMTMINTNIVGLIYLTRQLLPHMVSKDDGIIINLGSTAGTIPYPGANIYGASKAFVKQFSLNLRADLAGSHIRVTNIEPGLCEGTEFSKGQNFQRSALMVMRNG

SEQ ID NO: 9123 - DNA, 840 bp, Streptococcus pyogenes
atgaataatcgtcatttatttagtgggatatttttctttgttattagtttatgtctggcctttttattgctaaatattattatccctaagtcaaattcacgtttgaaaaagagtgattttctgaaaaaagaacaagtagctatccaatatgttgctataggagattcattgacagaaggagtaggtgatctaactcatcaaggtggttttgttcctttgttaacgaatgatctcagtgaatattttaaggctaatgttaatcatcaaaattacggcgtatctggtgataccagtcaacaaattcttgataggatgataaaacaaaagcagatacagttatctttaaaaaaagcagatataatgacgttaaccgttggtggtaatgatgttatggcagttattcggaagaatttagcggatttgcaagtttctagttttagaaagccagctcgtcagtatcaaaaacgattaagacagattatcgagttagccagaaaagataataaagatcttcctatttttattttaggcatctataatccgttttatttgaattttccagaactaactgatatgcaaaaagtgattgatgactggaataccaaaactaaggaggttgttggagaatacgatcgtgtgtactttgtgccaataaatgacctcttgtataaagggataaatggacaagaaggaattgttcattcttcaggagatcaaactacaattgtcaatgatgccttgtttactggggaccattttcacccaaataatactggctatcaaatcatgtcaaatgcagtaatggagaaaattaaaaagcatgaaaaaaaaatcaaacct

SEQ ID NO: 9124 - protein, 280 aa, Streptococcus pyogenes
MNNRHLFSGIFFFVISLCLAFLLLNIIIPKSNSRLKKSDFLKKEQVAIQYVAIGDSLTEGVGDLTHQGGFVPLLTNDLSEYFKANVNHQNYGVSGDTSQQILDRMIKQKQIQLSLKKADIMTLTVGGNDVMAVIRKNLADLQVSSFRKPARQYQKRLRQIIELARKDNKDLPIFILGIYNPFYLNFPELTDMQKVIDDWNTKTKEVVGEYDRVYFVPINDLLYKGINGQEGIVHSSGDQTTIVNDALFTGDHFHPNNTGYQIMSNAVMEKIKKHEKKIKP

SEQ ID NO: 9125 - DNA, 3495 bp, Streptococcus pyogenes
atgaaaaagaaagtcaaccaaggatcaaagcgctatcaatatctgttaaaaaagtgggggataggttttgtaatcgctgcaactgggactgtcgtgttagggtgcacccctagtatcttaacacatcaagttgctgctaaaaccattgttggactagcccgcgatgaagctcaacaaggagatggcaatgctaaatctggtgatggtcttcaatcgtctagcaaggaggcaaaaccagttttagacagctcgtcagctaatcctgctagtattgctgagcatcatttgcgtatgcattttaaaacattgccagctggtgagtcgctaggaagcttgggactttgggtgtggggagatgtggatcaaccttcaaaggattggccaaatggtgctatcaccatgacaaaagcgaaaaaagatgactatggctattatctagatgtgccactagcagctaaacaccgccagcaagtgtcttatctcattaataataaagctggagagaatctttcaaaggaccagcacatctcgcttctcacgccaaaaatgaatgaagtttggatagacgagaattaccatgcgcacgcttatcgacctttgaaaaaaggttaccttcgaatcaactaccacaatcaatcgggacactacgataacttagctgtctggacctttaaagatgtcaaaaccccaacgaccgactggccaaatggacttgacttgtcacataaagggcattatggagcttatgttgatgtccccttaaaagaaggagctaacgaaatcggatttttaatccttgataaaagtaagacaggagatgctattaaagtgcaaccaaaagattatctatttaaagagttagacaatcatactcaggtttttgtcaaagacactgacccaaaagtttacaacaatccttattatattgatcaggttagtctcaaaggagctgaacaaaccacgccaaatgagattaaagccatttttacgaccttagatgggcttgatgaagatgcggtgaaacaaaacatcaagatcactgacaaagcagggaaaactgttgcaattgatgagttgacacttgacagggataagtctgtaatgacattaaagggtgattttaaggcgcaaggtgcagtctacacggttacatttggagaagttagccaagtcgctcgccaatcctggcaattaaaagataaactctatgcttacgatggtgaacttggagctaccctagctaaggatggttctgttgatttagcgctatggtctccaagtgctgatactgttaaggttgtcgtttatgataaacaagatcagacaagggtggttggtcaagctgatttgaccaagtcggacaagggtgtttggagagctcatctaacttctgacagtgtcaagggcattagtgattacacaggctactattacctttatgaaatcacgcgcggtcaggaaaaagtcatggttttggatccttacgccaaatctctcgctgcctggaatgatgcgactgctactgatgacatcaaaacagcaaaagctgcctttattgatccaagcaaactaggaccaacaggccttgattttgccaaaattaacaactttaaaaagcgtgaagacgctattatctatgaagcacatgtgcgagattttacgtcagataaggctctagaaggcaagttaacacacccttttgggactttttcagctttcgttgaacagctagactatctcaaagacttgggggttacccacgttcaattgctaccggttttgagttatttttatgccaatgagctggacaagagccgctcaacagcctacacgtcttcagacaataattacaactggggttatgacccacaacactactttgccctttctggcatgtattcggcaaatcctaatgaccctgctttacgtatcgcagagcttaaaaaccttgtcaatgagattcacaaacgtggtatgggtgttatttttgatgtggtttataaccacacggctagaacctatctctttgaagatttggaacccaactactatcattttatgaatgctgatggtacagctagagagagttttggcggaggtcgtctaggaacgacacatgccatgagtcgtcgtatcttggtggattcgattacttatctgactcgtgaattcaaggtagatggttttcgtttcgacatgatgggtgaccatgatgcggcagctattgagcaagcctttaaggcagccaaagccattaatccaaataccattatgattggcgaaggctggcgtacctaccaaggtgatgaggggaaaaaagaaattgcggcagatcaagattggatgaaagcaaccaatacggtcggtgttttctctgatgatatcagaaataccctcaagtcaggttttccaaatgaaggcacagcagcctttattactggtggcgcaaaaaatctagaaggtttattcaaaacgatcaaagcacagcctggtaactttgaagcagatgccccaggagatgtagtgcagtatattgcagcccatgacaacctgaccttacatgatgtcattgccaaatccatcaataaggatcctaaagtggctgaagaagagattcacaagcgtattcgtctaggaaataccatgattttaactgctcaagggactgcctttatccattctggtcaggaatatggacgaaccaagcagcttctaaatcccgactacaagacaaaggcgtctgatgacaaggtgccaaataaggcgactctgattgatgctgtagcgcaatacccttacttcatccacgattcttatgattcgtctgatgcggtcaatcattttgactgggcaaaggcaacagattccatagctcacccgattagcaaccaaacaaaagcctatacacagggactaattgcgttgcgtcgctcaacagatgcctttacaaaagcaaccaaagctgaggtagatcgggatgtgaccttgatcacccaagcaggacaagatggtattcaacaagaggacctcatcatgggttaccaaacagtggcatcaaatggagatcgctatgctgtctttgtcaatgcagacaacaagacccgcaaggtagttttacctcaagcctaccgctatttgctaggagcccaagtgcttgttgatgctgagcaagctggtgttactgccattgctaagcctaagggagtccagtttaccaaagaaggcttgactattgaaggcctaactgccctggtcctcaaagtatcctcaaaaacggctaatccctctcagcaaaagagtcagacagacaatcatcaaaccaaaacaccagatggctcaaaagacctagacaaatcattaatgactagaccaaaaagagctaaaacaaaccaaaagctcccaaaaacgggtgaagcctcctcaaaaggcttattagcagctggaatagctctgcttttattggctattagcctgttgatgaagcgccaaaaagat

SEQ ID NO: 9126 - protein, 1165 aa, Streptococcus pyogenes
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 9127 - DNA, 1005 bp, Streptococcus pyogenes
atgaagagaattgcaatagatgctatgggtggagataacgctcctaaagctattgttgagggtgttaatcaagcaatagaagcattttcagatatcgaaattcaactttacggtgatcagacaaagattaactcctatcttattcaatcagatcgtgttgctattattcatacagatgaaaaaattatgtcagatgatgaacctgcaaaagctgttcgccgtaaaaagaaggcttcaatggttttagcagctaaggcagtgaaagaaggaaaagcagatgccattatttcagcagggaatacaggtgctcttttagctgtaggtttgtttgttgtggggcgtatcaagggagttgatcgtccaggattattatcaactattcccacagtaaccggattaggatttgatatgttggatcttggagctaatgctgaaaatacggcaaaacatttacatcaatatgctattttaggctctttctatgctaagaatgtacgtgggattgctaatccacgtgttggtctattaaacaatggtacagaagaaacaaaaggagatccccttcgtaaggccacttatgaacttttaacagcagataatacaatatcttttgttggtaatgtcgaggcgcgagaacttatgtcaggtgttgcagatgttattgtatcagatggtttcacgggaaacgcagtgttgaaatcaatagaaggaacagctattagcattatggggcaactgaaacagataattaatagcggcggtattaagactaaaattggagctagtctacttaaaagtagtctttacgagatgaagaagactcttgactactctagtgctggaggtgcagttttatttggtttaaaggcacctgttgtaaagtctcatggttctagtgatgtaaaagctattttttcaacgataaaacaagtacgtacgatgctagacactaacgtggtcggacaattagtagaagaatttgctaaggagactcaagtaaatgac

SEQ ID NO: 9128 - protein, 335 aa, Streptococcus pyogenes
MKRIAIDAMGGDNAPKAIVEGVNQAIEAFSDIEIQLYGDQTKINSYLIQSDRVAIIHTDEKIMSDDEPAKAVRRKKKASMVLAAKAVKEGKADAIISAGNTGALLAVGLFVVGRIKGVDRPGLLSTIPTVTGLGFDMLDLGANAENTAKHLHQYAILGSFYAKNVRGIANPRVGLLNNGTEETKGDPLRKATYELLTADNTISFVGNVEARELMSGVADVIVSDGFTGNAVLKSIEGTAISIMGQLKQIINSGGIKTKIGASLLKSSLYEMKKTLDYSSAGGAVLFGLKAPVVKSHGSSDVKAIFSTIKQVRTMLDTNVVGQLVEEFAKETQVND

SEQ ID NO: 9129 - DNA, 2010 bp, Streptococcus pyogenes
atgaaaaaatattttattttaaaaagtagtgtattgagtatcctgactagttttactctattagttacagatgttcaagcagatcaagttgatgtgcaattccttggcgtcaatgattttcacggcgctcttgataataccggaacagcttacacaccaagtggtaaaataccaaatgctgggacggctgctcaattaggtgcttatatggatgacgctgagatagacttcaagcaagcaaatcaagacggaacaagtatacgtgttcaagctggagatatggtcggagccagtcctgctaactctgcacttttacaagatgagcctactgtcaaagtctttaacaaaatgaaatttgaatatggcactcttggtaatcatgaatttgacgaaggactagatgaatttaaccgtatcatgacaggtcaagcgcctgatcctgaatcaacaattaatgatatcaccaaacaatatgagcacgaagcttcgcatcaaaccatcgtcattgctaatgttattgataaaaaaaccaaggatatcccctatggttggaaaccttatgctataaaagacatagccattaatgacaaaatcgttaagattggcttcattggtgttgtgactacagagattccaaatctcgttttaaagcaaaactatgaacactatcaatttttagatgtagctgaaaccattgccaaatatgctaaagaactacaagaacaacatgttcatgctattgtggttttagctcatgttcctgcaacaagtaaagatggtgttgttgatcatgaaatggctacggttatggaaaaagtgaaccaaatctatcccgaacatagcattgatattatttttgcaggacataatcatcaatacactaatggaactatcggtaaaacacgtatcgttcaagccctctctcaaggaaaagcttatgcagatgtccgtggtacgctagatactgataccaatgattttattaaaactccatcagcaaatgttgttgctgtagcaccaggtatcaaaacagaaaattcagatatcaaagctataataaatcatgctaatgatattgttaaaacagttactgaacgaaaaatcggaactgcaactaattcttcaactatttctaaaacagaaaatattgataaagaatctcctgtcggtaacttagcaacaacggctcagcttactattgctaagaaaacttttccaactgttgactttgctatgaccaataatggtggtattcgaagtgacctagttgtcaaaaatgaccggaccatcacctggggagctgcacaggctgtacaaccatttggtaatatccttcaagtcattcaaatgactggtcaacacatttacgatgtcctaaatcagcaatacgatgaaaaccagacctattttcttcaaatgtcaggtttaacatacacttatacagataatgatcctaagaactctgatacccccttcaagatagttaaggtttataaagacaatggtgaagaaattaacttaacaactacttacaccgttgttgtcaacgactttctttatggtggtggtgatggcttttcagcatttaaaaaagctaaattaatcggagctattaacacagatactgaagctttcatcacatatatcacaaatttagaagcatcaggtaaaactgttaatgctactataaaaggggttaaaaattatgtaacttcaaaccttgaaagttcgacaaaagttaatagtgctggtaaacacagtatcattagtaaggtttttagaaatcgtgatggcaatacagtgtctagtgaagtcatttcagaccttttgacttctactgaaaacactaataacagccttggcaaaaaagaaacaacaacaaacaaaaatactatctctagttccactcttccaataacaggggacaattataaaatgtctcctattatgacaatccttgccttgataagcttaggtggactaaacgcttttattaaaaaaaggaaatcc

SEQ ID NO: 9130 - protein, 670 aa, Streptococcus pyogenes
MKKYFILKSSVLSILTSFTLLVTDVQADQVDVQFLGVNDFHGALDNTGTAYTPSGKIPNAGTAAQLGAYMDDAEIDFKQANQDGTSIRVQAGDMVGASPANSALLQDEPTVKVFNKMKFEYGTLGNHEFDEGLDEFNRIMTGQAPDPESTINDITKQYEHEASHQTIVIANVIDKKTKDIPYGWKPYAIKDIAINDKIVKIGFIGVVTTEIPNLVLKQNYEHYQFLDVAETIAKYAKELQEQHVHAIVVLAHVPATSKDGVVDHEMATVMEKVNQIYPEHSIDIIFAGHNHQYTNGTIGKTRIVQALSQGKAYADVRGTLDTDTNDFIKTPSANVVAVAPGIKTENSDIKAIINHANDIVKTVTERKIGTATNSSTISKTENIDKESPVGNLATTAQLTIAKKTFPTVDFAMTNNGGIRSDLVVKNDRTITWGAAQAVQPFGNILQVIQMTGQHIYDVLNQQYDENQTYFLQMSGLTYTYTDNDPKNSDTPFKIVKVYKDNGEEINLTTTYTVVVNDFLYGGGDGFSAFKKAKLIGAINTDTEAFITYITNLEASGKTVNATIKGVKNYVTSNLESSTKVNSAGKHSIISKVFRNRDGNTVSSEVISDLLTSTENTNNSLGKKETTTNKNTISSSTLPITGDNYKMSPIMTILALISLGGLNAFIKKRKS

SEQ ID NO: 9131 - DNA, 1230 bp, Streptococcus pyogenes
atgtttaatcgtatccgcattcgttttatcatgattgcttctattgccatttttattattttaagttcaattgttggtattattaacacggcacgctgttaccaaagtcaacaagaaattaaccgtattttacatttaatttcctcaaataaaggtaaattacctggcactacggaaagctctaaacgacttggaacgaaactgtctgaagatagcctaagccagtttcggtattatagtgtcatttttaatgctaatggacatctactttcttctaatactgctaatatttcagctttagatagagaagaagcccaatattttgctagactttttgctaagtctggggaagaaaaaggcagttaccgtcaccaagatagtgtttattcgtacttgattactcagctgccaaatgaagaaaaactggttgtaattttagatactaccttttattttcgtagtgtaggagatttattagctgtttcagtgatgttggcctttggaggatttatcttttttgttgttttagtgagtcttttttccggtatggtcatcaaaccttttgtccaaaattatgagaagcagcgtcgctttattactaatgcaggccacgagttaaaaacaccactagccattatctcagccaataatgaattggtcgaattaatgactggagaatcagaatggaccaagagtacaagtgatcaggtgaagcgattgacaggcttgattaatcaaatgattactttggctcgtttggaggaacagccagatgtggtattacatatggtagacttttcagctattgctcaagatgcagctgaagattttaagagtctggttttgaaagatggtaaacgttttgatttgacgattcaaccgaatattatgattaaagcggaggaaaagtcattgtttgaacttgtgacaattttagttgataatgccaataaatattgtgatcctaaaggcttggtcaaggtatctttaaccactattggaagaagacgaaaacgagcgaaattagaagtttctaatacctatttggaaggaaaatccattgattacagccgcttctttgaacgcttttatcgcgaagacgaatcccataatagcaaagaaaaaggttatggaattggtttatctatggcagaaagtatggttaagttatttaaaggaacgataactgtaaattataaaaacgatgctattgtttttacagtggtgatt

SEQ ID NO: 9132 - protein, 410 aa, Streptococcus pyogenes
MFNRIRIRFIMIASIAIFIILSSIVGIINTARCYQSQQEINRILHLISSNKGKLPGTTESSKRLGTKLSEDSLSQFRYYSVIFNANGHLLSSNTANISALDREEAQYFARLFAKSGEEKGSYRHQDSVYSYLITQLPNEEKLVVILDTTFYFRSVGDLLAVSVMLAFGGFIFFVVLVSLFSGMVIKPFVQNYEKQRRFITNAGHELKTPLAIISANNELVELMTGESEWTKSTSDQVKRLTGLINQMITLARLEEQPDVVLHMVDFSAIAQDAAEDFKSLVLKDGKRFDLTIQPNIMIKAEEKSLFELVTILVDNANKYCDPKGLVKVSLTTIGRRRKRAKLEVSNTYLEGKSIDYSRFFERFYREDESHNSKEKGYGIGLSMAESMVKLFKGTITVNYKNDAIVFTVVI

SEQ ID NO: 9133 - DNA, 630 bp, Streptococcus pyogenes
atggtagaaaacactaaattactatgtagctgggtatggttattagcgttagctattctcataacgatctattcaacgtggctgtggtatcctcttgaggtggaccatctaaagttagaacaagttgtttttatgagcaaggatgctatcttgcataactataacggactactcaattacctcaccaatccttttgtgacaaggttggaatttgctaattttcactcatcggcagacggactcaagcattttgcagatgtgaagtggctttttcacctaactcaagtcgtttttcttggccttctttacccaacccttaagactttcacacaaaggttaaaaaccaaacgtttctggctccttcaaaaacctttaatactagcagctttgtttcctcttatgattggtctaatggctagtttcattgggtttgaacatttttttactctttttcatcaggtgctttttgtaggagatagcagctggctctttgatcccttgaaagattctgtgatttggatccttccagaagtctttttcttgcactgtttccttttctttatgatagtttacgaaatcatcctgtggagcttagtaggtttagcaagatggcagcgcctaaatgtagaa

SEQ ID NO: 9134 - protein, 210 aa, Streptococcus pyogenes
MVENTKLLCSWVWLLALAILITIYSTWLWYPLEVDHLKLEQVVFMSKDAILHNYNGLLNYLTNPFVTRLEFANFHSSADGLKHFADVKWLFHLTQVVFLGLLYPTLKTFTQRLKTKRFWLLQKPLILAALFPLMIGLMASFIGFEHFFTLFHQVLFVGDSSWLFDPLKDSVIWILPEVFFLHCFLFFMIVYEIILWSLVGLARWQRLNVE

SEQ ID NO: 9135 - DNA, 1344 bp, Streptococcus pyogenes
atgtttaaaaaatattcaataaaaaatcgtgtttggcgcgccgtcgttgaaattgtctttggagtttgtatcactgttttaatgattgcgataatatcgctttctttttcaaagttaaatatagtgacatctcataatgtgggagaagaattttatattaaagataaacagtcaatcaaacagttgaacaattatatgaagacattgggattagattatgttgtttttgatagaaaaacagataaagctatggaaggaaaatatttatctaaagaattttctttatttaacgaagttgcagaagaaaaaaataatctgacttttaattctgtacattatgatttatatactaatatcaattataatattgttataagatataatgagataccggagttctctaaccattaccttagaaatgtttcatataacatgttgacattttatattctgggaataggaacgagtatcagcattgtagttgctttaacacggtttgtaaaagaaatttctttgaatttcaaggaaatcaagaagttagcaaataaaatggggatagaagtcctttctgaaaatgaaaattattctcaaataatcgagtttgatgatatacttagaactttacatattaaaggtgataatttgaaaagtttgattgagcgagaaatattggaaaagcaagatctatcctttcaaattgcagcactttcgcatgatattaaaacacctttaacggttttaaaaggaaatcttgagttattagaattgactactttaaataaaaatcaggaaggttatattgtatctatgaacaatagtatttctgtttttgaaggctatttcaattctttaatatcttatacacgcatgctttcagaggatagatcagtgaaactaattttagttgaggagctattaagtgagttacattttgaagtcgatgacttattgaatatcaataatattgaattttctatttgtaatagacttattatcacttctttttatggagatgaggaaaatctgataagagctctttctaaccttttagttaatgcaataagatttatgcccgtattagataaaaaaatcgaagttatactgtctgagtcaggagagcaaattcattttgaaatatggaataatggtgagcgtttcagtgatagtacactgaaaaagggagataaattattttacacggaagattatagcagaggtaacaaacattatggaatcggtttggcatttgttaaaggcgttgctatcaaacacggtgggaatcttcaattgaataatccagctagaggaggtgctagcgccataatctcgataaaaaagaaaatt

SEQ ID NO: 9136 - protein, 448 aa, Streptococcus pyogenes
MFKKYSIKNRVWRAVVEIVFGVCITVLMIAIISLSFSKLNIVTSHNVGEEFYIKDKQSIKQLNNYMKTLGLDYVVFDRKTDKAMEGKYLSKEFSLFNEVAEEKNNLTFNSVHYDLYTNINYNIVIRYNEIPEFSNHYLRNVSYNMLTFYILGIGTSISIVVALTRFVKEISLNFKEIKKLANKMGIEVLSENENYSQIIEFDDILRTLHIKGDNLKSLIEREILEKQDLSFQIAALSHDIKTPLTVLKGNLELLELTTLNKNQEGYIVSMNNSISVFEGYFNSLISYTRMLSEDRSVKLILVEELLSELHFEVDDLLNINNIEFSICNRLIITSFYGDEENLIRALSNLLVNAIRFMPVLDKKIEVILSESGEQIHFEIWNNGERFSDSTLKKGDKLFYTEDYSRGNKHYGIGLAFVKGVAIKHGGNLQLNNPARGGASAIISIKKKI

SEQ ID NO: 9137 - DNA, 825 bp, Streptococcus pyogenes
atgaattatacaggtaaggtaaaacgagttgctattattgcaaatggtaagtaccaaagtaaacgcgtcgcctccaaacttttctccgtatttaaagatgatcctgatttctatctttcaaagaaaaatccggatattgtgatttctattggcggagatgggatgctcttatctgcctttcacatgtatgaaaaagaattagataaggtacgttttgtaggaatccacaccggtcatcttggcttttataccgattatagggattttgaagttgataaattaattgataatttaagaaaagacaagggagaacaaatctcttatccgattttaaaagttgctattactttagatgatggtcgtgtggttaaagcgcgtgctttgaatgaagcgacggttaagcgtattgaaaaaacgatggtagcagatgttattattaaccatgtcaaatttgaaagcttccgaggtgatgggatttcagtatcgaccccgacagggagcacagcctacaataaatctttaggtggtgctgtcttgcatccgacgattgaagcgctgcaattgacggaaatttccagtcttaataaccgtgtctttagaaccttgggctcatcaatcattattcccaaaaaagataagattgagttagtgccaaaacgattaggaatttataccatttccattgataataaaacctatcagttaaaaaatgtgacgaaggtggagtattttatcgacgatgagaaaattcattttgtttcctctccgagtcatacgagcttttgggaaagggtcaaggatgcctttattggagagattgactca

SEQ ID NO: 9138 - protein, 275 aa, Streptococcus pyogenes
MNYTGKVKRVAIIANGKYQSKRVASKLFSVFKDDPDFYLSKKNPDIVISIGGDGMLLSAFHMYEKELDKVRFVGIHTGHLGFYTDYRDFEVDKLIDNLRKDKGEQISYPILKVAITLDDGRVVKARALNEATVKRIEKTMVADVIINHVKFESFRGDGISVSTPTGSTAYNKSLGGAVLHPTIEALQLTEISSLNNRVFRTLGSSIIIPKKDKIELVPKRLGIYTISIDNKTYQLKNVTKVEYFIDDEKIHFVSSPSHTSFWERVKDAFIGEIDS

SEQ ID NO: 9139 - DNA, 1068 bp, Streptococcus pyogenes
atgagacgcgaattattactagaaaaaattgaaacctacaaggctatcatgccctggtatgttttagattattaccaatccaaattagctgttccatacagctttaccaccttatatgagtatttaaaagaatacaaacgcttttttgattggctgatggatgctgatttaacgcaggcgccaaagattgctgatattgacttgagcacgcttgagcaccttaccaagaaggatttagaggcctttgtgctttatttgcgggaacgaccttctctcaacacctattccaccaaagaggggctttctcaaaccactattaatcggaccttgtctgccttatcaagcctttacaagtacttgactgaagaggttgaaaatgaccaaggggagccttatttttatcggaatgttatgaaaaaagtgtcaacaaaaaagaaaaaagaaaccctggcttccagagcggaaaatattaagcagaaactgtttttaggtgatgaaactctagctttcttggattatgtggataaggaatatgagcaaaaattgtctaatcgtgccaaatcttctttccgtaaaaataaggagagggatttggctattattgctctactacttgcttctggtgttcgtttgtctgaagcagtgaatcttgatttaaaagatgtcaatctaaatatgatgattatcgaagttattcgcaaaggcggaaaacgtgattcagtcaatgtagcaggttttgcgaaaggttatttggagtcttatttagctgttcgtcagagacgttacaaggctgaaaaacaggatcttgctttctttttaacagaataccgtggcgttccaaatcgaatggatgcttctagtatagaaaagatggttggcaagtactctgaggattttaaaattcgtgtgactcctcacaaattgcgtcatacgctagcgacaagactatatgatgctactaaatctcaggtgttagttagtcatcaattaggccattcctctactcaagtcacggatctttatacccatattgtcaatgatgagcaaaaaaatgctttagataacctt

SEQ ID NO: 9140 - protein, 356 aa, Streptococcus pyogenes
MRRELLLEKIETYKAIMPWYVLDYYQSKLAVPYSFTTLYEYLKEYKRFFDWLMDADLTQAPKIADIDLSTLEHLTKKDLEAFVLYLRERPSLNTYSTKEGLSQTTINRTLSALSSLYKYLTEEVENDQGEPYFYRNVMKKVSTKKKKETLASRAENIKQKLFLGDETLAFLDYVDKEYEQKLSNRAKSSFRKNKERDLAIIALLLASGVRLSEAVNLDLKDVNLNMMIIEVIRKGGKRDSVNVAGFAKGYLESYLAVRQRRYKAEKQDLAFFLTEYRGVPNRMDASSIEKMVGKYSEDFKIRVTPHKLRHTLATRLYDATKSQVLVSHQLGHSSTQVTDLYTHIVNDEQKNALDNL

SEQ ID NO: 9141 - DNA, 1080 bp, Streptococcus pyogenes
atgcctaagaagattttatttacaggtggtggaactgtaggtcatgtcaccttgaacctcattctcataccaaaatttatcaaggacggttgggaagtacattatattggtgataaaaatggcattgaacatacagaaattgaaaagtcaggccttgacgtgacctttcatgctatcgcgacaggcaagcttagacgctatttttcatggcaaaatctagctgatgtttttaaggttgcacttggcctcctacagtctctctttattgttgccaagcttcgccctcaagcccttttttccaaaggtggttttgtctcagtaccgccagttgtggctgctaaattgcttggtaaaccagtctttattcatgaatcagatcggtcaatgggactagcaaacaagattgcctacaaatttgcaactaccatgtataccacttttgagcaggaagaccagttgtctaaagttaaacaccttggagcggtgacaaaggttttcaaagatgccaaccaaatgcctgaatcaactcagttagaggcggtgaaagagtattttagtagagacctaaaaaccctcttgtttattggtggttcggcaggggcgcatgtgtttaatcagtttattagtgatcatccagaattgaagcaacgttataatatcatcaatattacaggagaccctcaccttaatgaattgagttctcatctgtatcgagtagattatgttaccgatctctaccaacctttgatggcgatggctgaccttgtagtgacaagagggggctctaatacactttttgagctactggcaatggctaagctacacctcatcgttcctcttggtaaagaagctagccgtggcgatcagttagaaaatgccacttattttgagaagaggggctacgctaaacaattacaggaacctgatttaactttgcataattttgatcaggcaatggctgatttgtttgaacatcaggctgattatgaggctactatgttggcaactaaggagattcagtcaccggacttcttttatgaccttttgagagctgatattagctccgcgattaaggagaag

SEQ ID NO: 9142 - protein, 360 aa, Streptococcus pyogenes
MPKKILFTGGGTVGHVTLNLILIPKFIKDGWEVHYIGDKNGIEHTEIEKSGLDVTFHAIATGKLRRYFSWQNLADVFKVALGLLQSLFIVAKLRPQALFSKGGFVSVPPVVAAKLLGKPVFIHESDRSMGLANKIAYKFATTMYTTFEQEDQLSKVKHLGAVTKVFKDANQMPESTQLEAVKEYFSRDLKTLLFIGGSAGAHVFNQFISDHPELKQRYNIINITGDPHLNELSSHLYRVDYVTDLYQPLMAMADLVVTRGGSNTLFELLAMAKLHLIVPLGKEASRGDQLENATYFEKRGYAKQLQEPDLTLHNFDQAMADLFEHQADYEATMLATKEIQSPDFFYDLLRADISSAIKEK

SEQ ID NO: 9143 - DNA, 1638 bp, Streptococcus pyogenes
atgaccaaaccatttcatcataagaaactaaaacaaataactataatagctgcaactagcctttttttattcctgatcggtggtgccttttactactctaaaaatcattgtattaatgcctatcttaaagctcgatcggcccaatcaggaccagtttttgagaatatcaaagcatatctagtctgggatgatactaatgagcagatcacaaatgacgaggcgatgtatactaagtttagaaggtatagtcagaaagaattgaggcaaaaaaagcaggatttaaaagccgctagtcaagatagtgccgttcaagtaaagtctgttggtcgtcgtttttggatttttcctgattatcggattgccataaaacccatggatttaacgataaaaacgaatgtgcctcaagcagacgttcttttaaatcaaaaaaaagttgctgtttctgattcagaacagttctcagtcaagcttgatcggctaccaacggcagaatataccgcaagtatcagaggcaaacacaacgggcgaaacattaaagtcaacaaatcatatgatggtgataatcccgtgctagatttgagtgtgtcttttagaacttttttggtaacaagcaatgctaagcaaggagatctttacttcgatgataaccatattggcacattaaaagatggtcaattacaagtagaagattaccctgttacagaaaacgcacaagcttatatgaaaacaacattcccagatggtgagttaagatcacaaaaatatgctctagctgatgttgaagaaggagcaaccctggagattttagttacagatcttttagaagaggacaaggcaggggagctattagtatcagcttttgatcagctgatgcactacctcagtacaggtcaagactcatctaacttacgtagcgtctttgaggcagggtctagcaacgcattttataggggattgaaagagtccataaaagcgaaatttcagacagatacaagaaaagccagccgtctcaatattccatctatccttttgacaacaatgactcaagtgggtaaaacaacttacgtgcttgatttcacagctacctacgaatttttgtatgacaagtcaacagatcctgagcagcatacctctggacatattaatcaagacttgactggaaaagtgactgtaaaaaaagttggacagcattaccttatcagccagtccggctccaaaaatattactgttgttaaagaggacaatcaactcaaagcgccatctgtctttcctgagtctattttgggaacgtggacaggccaagccaatggtttgagcatccatatgtctctagcatcagatggaacaattacgactaaagttgaagatcaaaaaggcaaccgttctaaagaaactcggacagctaaaattagtaaagttgaagacaaaggcaatggtttttatctttatacgccagatcctggaagtgacataagcgccttagttccagaaggaggattggggggtgcaaatgtcaaatatgcttatggtttcaaaatatctggtaaaacagcctctccagtggtgtggcaggcagcattaacacatgaatttgattataccaagccactttcgggagtaactttgcaaaagcaacca

SEQ ID NO: 9144 - protein, 546 aa, Streptococcus pyogenes
MTKPFHHKKLKQITIIAATSLFLFLIGGAFYYSKNHCINAYLKARSAQSGPVFENIKAYLVWDDTNEQITNDEAMYTKFRRYSQKELRQKKQDLKAASQDSAVQVKSVGRRFWIFPDYRIAIKPMDLTIKTNVPQADVLLNQKKVAVSDSEQFSVKLDRLPTAEYTASIRGKHNGRNIKVNKSYDGDNPVLDLSVSFRTFLVTSNAKQGDLYFDDNHIGTLKDGQLQVEDYPVTENAQAYMKTTFPDGELRSQKYALADVEEGATLEILVTDLLEEDKAGELLVSAFDQLMHYLSTGQDSSNLRSVFEAGSSNAFYRGLKESIKAKFQTDTRKASRLNIPSILLTTMTQVGKTTYVLDFTATYEFLYDKSTDPEQHTSGHINQDLTGKVTVKKVGQHYLISQSGSKNITVVKEDNQLKAPSVFPESILGTWTGQANGLSIHMSLASDGTITTKVEDQKGNRSKETRTAKISKVEDKGNGFYLYTPDPGSDISALVPEGGLGGANVKYAYGFKISGKTASPVVWQAALTHEFDYTKPLSGVTLQKQP

SEQ ID NO: 9145 - DNA, 1047 bp, Streptococcus pyogenes
atgaaagcagcaacttacctttcaaccggaaatctacagctcatagacaaaccaaaaccagtcattataaagcctacagatgctatcgtccagttggtaaaaaccactatttgtggaactgatttgcatatcttaggtggggatgttcccgcatgtaaagaaggaacaatccttggtcatgaaggaattggaattgttaaggaggtcggtgatgcggttactaactttaaaatcggagataaagtgattatttcttgcgtcacatcatgtcatacctgttattattgtaaacgaggcctttcgtcacattgtcaagatggcggttggattcttggccatttaattaatggaacacaagcagaatatgtccatatcccacatgcagatggtagtctctatcatgctcctgatacgattgatgatgaggcacttgtcatgctttctgatattttaccaacttcatatgaaattggtgtcttgccatcacatgtcaagcctggagataatgtttgtattgttggtgccggtccagtaggactcgcagccctactaaccgttcaatttttctctccagccaatattattatggtcgacttatctcaaaatcgccttgaagcagctaaaacatttggagccacacacacgatttgttcaggaagtagtgaagaagtcaaggctatcattgacgatataaccaatggacgtggtgtcgatatttccatggagtgtgttggttatcccgcgacatttgatatttgtcaaaaaattatatcagtaggtgggcatattgctaacgttggggttcatgggaaaccagttgatttcaacctggatgaattatggattaaaaatatcaccttaaacactggacttgttaatgccaatacaactgaaatgctactaaatgtcttgaaaactggaaagattgacgcaacaagacttattacacatcattttaaactttcagaagttgaaaaagcttatgaaacctttaaacatgctggtgcaaataacgccttgaaagttattattgataatgatattagc

SEQ ID NO: 9146 - protein, 349 aa, Streptococcus pyogenes
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 9147 - DNA, 207 bp, Streptococcus pyogenes
atggaatcaaaagaaatttatttgactaagtctccttatataagggggagtttagaaattcacagtaaaaataggaaacatgaaaaaatcaatttatatgacgcaaaacccaatagcaccagatctgatgtctttaaaaaatataaagacaataagactataaatatgaaagatttcagccattttgatatttatctttggactaaa

SEQ ID NO: 9148 - protein, 69 aa, Streptococcus pyogenes
MESKEIYLTKSPYIRGSLEIHSKNRKHEKINLYDAKPNSTRSDVFKKYKDNKTINMKDFSHFDIYLWTK

SEQ ID NO: 9149 - DNA, 375 bp, Streptococcus pyogenes
atgtatcaaacaaaaataacaggcaaccgcctttaccacacggtttcgaaaggctacggagatagtgtgaccttatttggaaaaactgatcaaggggaaacccctatgagtttactggttatcgccttgtcttcttgtgtgactatgtgtgtgcagggtttttaccatcgtcaatttcagcaagacacacttgctgtttctgttgaggctagttatgaggaagaagtttttgaactacttgttaggattgatgatgttttagatgacaaaaagaaagctgatttattggcttacattggaacttattgtcgtgtgaaacaactcctcaaacctgaagttacggtgaccattacgttggaaggactgtctcatgtc

SEQ ID NO: 9150 - protein, 125 aa, Streptococcus pyogenes
MYQTKITGNRLYHTVSKGYGDSVTLFGKTDQGETPMSLLVIALSSCVTMCVQGFYHRQFQQDTLAVSVEASYEEEVFELLVRIDDVLDDKKKADLLAYIGTYCRVKQLLKPEVTVTITLEGLSHV

SEQ ID NO: 9151 - DNA, 624 bp, Streptococcus pyogenes
atgcttaaaaaaccgattattattggtgtaactggtggttcaggtggcggtaaaacaagtgtgtcacgcgctattttggacagttttccaaatgctcgtattgcaatgattcaacacgattcttactataaagatcagtctcacatgagttttgaagaaagggtcaagaccaattatgaccatcctctagcttttgatacagattttatgattcagcaactaaaagaattattagctggtagacctgtagatattcctatctatgattacaaaaagcatacccgcagtaatacgacctttcgtcaggatcctcaggatgttattattgttgaaggtattcttgtcctagaagatgagcgtttgcgagatttgatggatatcaagctctttgtagacacagatgacgatattcgtattattcgtcgtattaagcgtgacatgatggaacgtggcagaagcttagaaagtattattgatcagtacacaagcgtggtaaagcctatgtatcatcagtttattgagccaagtaaacgctatgctgatattgttattccagagggagttagtaatgtcgttgctattgatgttattaatagtaaaattgcgagtattcttggagaagta

SEQ ID NO: 9152 - protein, 208 aa, Streptococcus pyogenes
MLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 9153 - DNA, 630 bp, Streptococcus pyogenes
atggaacattttaagacaatcaaagccagtggttttttcgaagaaagtattaaaaaatctcgtttcatttgtcatatcaaacgagtgagcactgaagaagatggtaagaattttgttaatgctatcaaaaaagaacattacaaagctaatcattcctgctttgcgatgattatcggtaacaacagacagatcaagcgctcaagtgatgatggtgaaccttcaggaactgctggaatacctatcctttctgtgttagaaaagcagtgtttaacaaatgtagtagttgtggtaacgcgttactttggtggtattaaattaggaacaggtgggttaatcagagcatactctaacatgaccgcaacagctattaaacgatttggcatcattgaagttaaacagcagataggactagaaatcacactttcttatccccaatatcaactatactctaacttgctagatcaattggctttaaccgaaacagaaactaagttttcagacacgataaagacaacactttattgtgatactgaacgtgtggaaaatctcattgatactttaacaaattattatcatggtcagataagctgtgagaaaatcggatccaaagttattgaattcccctgtgat

SEQ ID NO: 9154 - protein, 210 aa, Streptococcus pyogenes
MEHFKTIKASGFFEESIKKSRFICHIKRVSTEEDGKNFVNAIKKEHYKANHSCFAMIIGNNRQIKRSSDDGEPSGTAGIPILSVLEKQCLTNVVVVVTRYFGGIKLGTGGLIRAYSNMTATAIKRFGIIEVKQQIGLEITLSYPQYQLYSNLLDQLALTETETKFSDTIKTTLYCDTERVENLIDTLTNYYHGQISCEKIGSKVIEFPCD

SEQ ID NO: 9155 - DNA, 2985 bp, Streptococcus pyogenes
atggataaacatttgttggtaaaaagaacactagggtgtgtttgtgctgcaacgttgatgggagctgccttagcgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaa

SEQ ID NO: 9156 - protein, 995 aa, Streptococcus pyogenes
MDKHLLVKRTLGCVCAATLMGAALATHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 9157 - DNA, 591 bp, Streptococcus pyogenes
atgaaacagtttattaaagaatggggcccattcactctctttttaattctctttggtctatctcgtctttttttgtggcaggctgttaaagtagacggccattctatggacccaactctagctcatggcgaacgccttatcgtttttaatcaagctagaattgatcgctttgatattgtagttgctcaggaagaagaaaacggacaaaagaaagaaatcgtaaaaagagttattggattgccaggcgataccatttcttataatgatgacacactttatattaatggtaaaaaaacagttgagccgtatttggctgagtatctaaaacaatttaaaaacgataaactccaaaaaacttacgcctataataccctattccaacagttagcagaaacatctgatgcttttacaactaattctgagggacaaacacgctttgagatgagtgttccaaaaggagaataccttcttcttggtgatgatcgtattgtttccagggatagtcgcgaagttggtagtttcaaaaaagaaaaccttatcggtgaagtgaaagctcgtttttggccactcaataaaatgaccgtttttaat

SEQ ID NO: 9158 - protein, 197 aa, Streptococcus pyogenes
MKQFIKEWGPFTLFLILFGLSRLFLWQAVKVDGHSMDPTLAHGERLIVFNQARIDRFDIVVAQEEENGQKKEIVKRVIGLPGDTISYNDDTLYINGKKTVEPYLAEYLKQFKNDKLQKTYAYNTLFQQLAETSDAFTTNSEGQTRFEMSVPKGEYLLLGDDRIVSRDSREVGSFKKENLIGEVKARFWPLNKMTVFN

SEQ ID NO: 9159 - DNA, 696 bp, Streptococcus pyogenes
atgaagacacttgcatttgatacctcaaataaaaccttgtcccttgctatacttgatgatgagacacttctagcagatatgacccttaacattcagaaaaaacatagtgttagccttatgcctgctattgattttttgatgacttgtactgatcttaaacctcaagatttagaaagaatagtggttgcaaaaggccctggatcttacacaggtttacgagtggcagttgctactgcaaaaacgttagcgtacagtttaaatattgcattggtcgggatttcgagtctatatgctttggctgcgtctacttgtaaacagtatccaaatactttggtggtgccattgattgatgctagaaggcaaaatgcgtatgtaggttattatcggcaaggaaaatcagtgatgccacaagcccatgcttcactagaagttattatagaacaattagtagaagaaggacagctgatttttgttggggagactgctccttttgctgagaaaattcaaaagaaactacctcaggcgatactacttccaacccttccttctgcttacgaatgtggtcttttggggcaaagtttggcaccagaaaatgtagacgcctttgtccctcaatatctcaagagagtggaagctgaagaaaactggctcaaagataatgagataaaagatgatagtcactacgttaagcgaatc

SEQ ID NO: 9160 - protein, 232 aa, Streptococcus pyogenes
MKTLAFDTSNKTLSLAILDDETLLADMTLNIQKKHSVSLMPAIDFLMTCTDLKPQDLERIVVAKGPGSYTGLRVAVATAKTLAYSLNIALVGISSLYALAASTCKQYPNTLVVPLIDARRQNAYVGYYRQGKSVMPQAHASLEVIIEQLVEEGQLIFVGETAPFAEKIQKKLPQAILLPTLPSAYECGLLGQSLAPENVDAFVPQYLKRVEAEENWLKDNEIKDDSHYVKRI

SEQ ID NO: 9161 - DNA, 669 bp, Streptococcus pyogenes
atgaatacacaaaaatttcaatcagtttttgacatcattgggccagtaatgattggtccatcaagtagtcacacagctggtgccgtcagaattggtaaggtagtccattccatctttggagatattcctgatgaagtgacgtttcacctttataattcatttgctaaaacctacagaggacatggtactgataaggctcttgttgcaggaattatgggtatgggtactgataatcctgatattaaaaattctctagaaattgctcatcaaaaagggataaaaatctattgggatatcttaaaagatagtaatgctccccatcccaatactgttaaaatcagtgtcaaaaaagctgacaaaacacttagtgttactggtgtttcaattggaggaggaaacattcaagtaacagaactaaatggtttttctgtctcgttatccatgaatactcctactatagttactgtacacaaagatattcccggaatgatcgcaaaggtaactgatatcctatcttccaataatattaatatcgccacaatgaatgttacacgtgaatccgctggtgaaaaagctactatgattatagaagtcgattctagagagtgccaagaagcagccaaccaaattgcaaaaattcctcatatttataatgtcaacttctttgac

SEQ ID NO: 9162 - protein, 223 aa, Streptococcus pyogenes
MNTQKFQSVFDIIGPVMIGPSSSHTAGAVRIGKVVHSIFGDIPDEVTFHLYNSFAKTYRGHGTDKALVAGIMGMGTDNPDIKNSLEIAHQKGIKIYWDILKDSNAPHPNTVKISVKKADKTLSVTGVSIGGGNIQVTELNGFSVSLSMNTPTIVTVHKDIPGMIAKVTDILSSNNINIATMNVTRESAGEKATMIIEVDSRECQEAANQIAKIPHIYNVNFFD

SEQ ID NO: 9163 - DNA, 549 bp, Streptococcus pyogenes
atgtcctgttgtttttttgtggttctctttatactagggatagttaaaaagaaaaggagactcaaaatgtcgatagagacaagagcagcgtttgaaaaagttaagcccattattttgaaattaaagcgacactattatattcaattgtgggatagagatgactggttacaagaaggacatattatcttattacagttactagaaaggtacccagagttaattgaggaagaagagcgtttatatcgctattttaaaacaaaattttcatcttatttgaaagatttattacgccgtcaagaaagtcaaaagcgtcagttccataagttagcatatgaagagataggggaggttgcacatgccattccatcgagagggttatggctagacgactatgtggcttatcaagaggtaatagctagcttagagaaccaattaaattcgcaagagcgtatgcagtttcaagcacttatcaggggcgaacgtttcaagggaagacgtgctctacttaggaagatcagtccctattttaaggaatttgcacagcagttg

SEQ ID NO: 9164 - protein, 183 aa, Streptococcus pyogenes
MSCCFFVVLFILGIVKKKRRLKMSIETRAAFEKVKPIILKLKRHYYIQLWDRDDWLQEGHIILLQLLERYPELIEEEERLYRYFKTKFSSYLKDLLRRQESQKRQFHKLAYEEIGEVAHAIPSRGLWLDDYVAYQEVIASLENQLNSQERMQFQALIRGERFKGRRALLRKISPYFKEFAQQL

SEQ ID NO: 9165 - DNA, 2133 bp, Streptococcus pyogenes
atgatgtccaaactagtttttttctggcaaaatagagaaaaagaatttagggactttggaggattttctgaaaaaagcgtctatttttgtgatacaatagacaatagaaaacgtttaattttagttgtaataaacagagaggttttacttatgacatttgatgcaattgaccagttggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttacacttagctggttatgatttatctgtagaagatttaaagaacttccgtcaatggggttctaaaacaccaggtcacccagaagtgaaccacacagacggtgtcgaagcaaccacaggacctcttggtcaagggatcgcaaatgccgttgggatggccatggcagaagctcatctagcagctaaatttaacaaaccaggctttgacatcgttgatcactacacatttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtgcctgctgaagtaacagagcgctttgctcaaggtcttcaagcgcgtggtgaaaaagcagaacaagcctggaatgacttgtttgcagcttatgaagcagaatatccagaattagcagcagaataccaaaaagcctttactaacgaagctgctcaagtagaacttgaagcgcacgaacttggtagttcaatggcgagtcgtgtatccagtcaacaagccatccaacaaatttcagaacaagtagcctctttctggggtgggtcagcagacctttcagcttcaaacaatactatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgtcggtgaagatgggccaacgcacgaaccaattgaacaattggcaagtgttcgctcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggcacaaaagaattggcagaagatggtcttagcaaaggagcttatatcttgtcagaagccaaaggcgaccttgatggtatcttgattgcaacaggttcagaagtgaaactggcaatggatactcaagaagctcttgaagcagaaggcattcatgtgcgtgtcgtatctatgccatcacaaaatatctttgacgaacagtcagcagagtataaagaaagcatcctaccagcagctgtgactaaacgtctcgctatcgaagcaggttcaagctttggctgggcaaaatatgtcggcctatcaggaaaaacattgaccattgacacttggggtgcttcagctccaggaaatcgtatcttcgaagaatatggtttcactgtggcaaatgcaactgagttatacaaatcactc

SEQ ID NO: 9166 - protein, 711 aa, Streptococcus pyogenes
MMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLSKGAYILSEAKGDLDGILIATGSEVKLAMDTQEALEAEGIHVRVVSMPSQNIFDEQSAEYKESILPAAVTKRLAIEAGSSFGWAKYVGLSGKTLTIDTWGASAPGNRIFEEYGFTVANATELYKSL

SEQ ID NO: 9167 - DNA, 801 bp, Streptococcus pyogenes
atgacatcagtgtttttaaccagtggttgggctttttatgattacctcatctcaccgattccacatgggaaactttttagttggcatgctgtttttgatgccattccaaatattatccaacggcttccaattacgcttggtttgacactatcaggagcaacctttggcttggttttggctttgatttttgcccttgtcaaaattaataaagtgaagctactataccctattcaagctatttttgtgagtttcttgcgaggaactcctattttggtacagttgatgttgacctactacggtattcccctctttctaaaatttctcaatcagaagtatggctttgattggaatgttaatgcaattccggcttctatttttgccattacagcctttgcttttaatgaagcagcctacgctagtgaaactattcgggcagccattttatcagtagatacaggtgaaattgaagcagcaaaaagtctaggcatgacttctgtgcaggtttaccgtcgtgtcattattcctaatgcaactgttgtggctattccaaccttgattaatgggttaattggcttaactaaaggaacatcgcttgcctttaatgcagggattgtcgaaatgtttgcccaggctcaaattctaggcggatcagattaccgttattttgaacgttatatctctgttgctcttgtctattggtctatcagtattttgatggagcaagtaggtcgcttgattgaaaacaagatggccatcaaagcaccagaacaagctagaaatgaaaagttaggagaattgcgt

SEQ ID NO: 9168 - protein, 267 aa, Streptococcus pyogenes
MTSVFLTSGWAFYDYLISPIPHGKLFSWHAVFDAIPNIIQRLPITLGLTLSGATFGLVLALIFALVKINKVKLLYPIQAIFVSFLRGTPILVQLMLTYYGIPLFLKFLNQKYGFDWNVNAIPASIFAITAFAFNEAAYASETIRAAILSVDTGEIEAAKSLGMTSVQVYRRVIIPNATVVAIPTLINGLIGLTKGTSLAFNAGIVEMFAQAQILGGSDYRYFERYISVALVYWSISILMEQVGRLIENKMAIKAPEQARNEKLGELR

SEQ ID NO: 9169 - DNA, 1401 bp, Streptococcus pyogenes
atgttattaacaatgctggcttatgccatgattattgtctttatgtacgtggtaatgaagaaaaaaatgaccccttttactgctttggtcatgattccattaatcatgacgattgctgttatactgactggttcagctgacttcaatgcagatgccaaatttgttgcctttgttggtgacggtggaattgctaaagacctaacagctatcggaccaatggttatgtatggtatcaacaatactgctaaaacaggtatcatgttgctatttgccattttgttcttctctgtcatgttagatgcaggattgtttgatccgattactgaaaagatgattcgctttgctaaaggtgatccaatgaaggtgcttatcgcaacagctgtcgttgctgctgcagtatctcttaatggtgatggaacaaccactactttaatttgttgctctgctttcttacctatctataaaaaattggacatgaaaatcatgaacctaggtgtcttgattattcttcaaaatactattatgaacttactgccatggggtggccctactgctcgtgcgatgtctgttcttggtgtcggtcctgaaattcttggctatcttgcaccgggtatgattttatctcttctttatgtgatttgttgggttgctccaagcatggggcgtaaagaacgtgcaagacttggtgttattgacttgtctgaagaagacatgcgtcaactcacagacattactgacccagataccctttttattcgtcgtcctaaaaactttgttttcaatgctatcttaaccattggattaatcacttggttagttgctggctctttcaacaaatctattgctatggcaccgcttcttctttttgcggtgggaacttgtatcgccttgatggtcaattacccagtgcttaaagatcaatcaaaacgcattggtgacaatgctggtgatgcggttcaagtggttattctcgtctttgctgctggtatctttatgggtctttttcaaggttctggtatggctagcgctcttgcacaaagttttgcaaccattattccaaaacaactggcaggtttctggggtctcgttattgccttagtttctgcacctggtaccttctttatctccaatgatggtttttactatggtatcttgcctgttcttgcagaagctggtgctgaatatggtttcagtaacatggctatggcacttgcttccctcatgggacaagccttccacttacttagtccattagttgccttcatttatcttcttcttcgcttgacaggtcttgacatgggggaatggcaaaaagaggctgctaaatatgcccttatcatctttgttatctttgtggtaaccattattgccatgggacaaatgccactttacattccacaa

SEQ ID NO: 9170 - protein, 467 aa, Streptococcus pyogenes
MLLTMLAYAMIIVFMYVVMKKKMTPFTALVMIPLIMTIAVILTGSADFNADAKFVAFVGDGGIAKDLTAIGPMVMYGINNTAKTGIMLLFAILFFSVMLDAGLFDPITEKMIRFAKGDPMKVLIATAVVAAAVSLNGDGTTTTLICCSAFLPIYKKLDMKIMNLGVLIILQNTIMNLLPWGGPTARAMSVLGVGPEILGYLAPGMILSLLYVICWVAPSMGRKERARLGVIDLSEEDMRQLTDITDPDTLFIRRPKNFVFNAILTIGLITWLVAGSFNKSIAMAPLLLFAVGTCIALMVNYPVLKDQSKRIGDNAGDAVQVVILVFAAGIFMGLFQGSGMASALAQSFATIIPKQLAGFWGLVIALVSAPGTFFISNDGFYYGILPVLAEAGAEYGFSNMAMALASLMGQAFHLLSPLVAFIYLLLRLTGLDMGEWQKEAAKYALIIFVIFVVTIIAMGQMPLYIPQ

SEQ ID NO: 9171 - DNA, 1062 bp, Streptococcus pyogenes
atgtctaaaaatgcgcaaaaaattgctgtaccattgatttctgtcttgctaggatttttacttggcgctattattatggttatctttggttatgatcctatctgggggtatgaaggtttattccaaattgcctttggtagtgttaaaaatattggagaaatattccgttcaatggggccattgattttaatagcgcttggctttactgttgctagccgtgcaggcttctttaacgttggtttgtctggacaggctttagctggatggatttcagcaggttggtttgcactcttaaatccagatatgcctcgtccattattgattcttatgacagctcttatcggaatgattgctggtggtattgctggagctattccagggatacttcgtgcttatcttggtacaagtgaagttatcgttacgattatgatgaactacatcattttatatgtcggaaatgctattgttcaacgtggttatcctgagagtgtcaaacaaagtattgattcaactattcaagttagtgataatgctagttatcaaacgcattggttatcagccctaactaataactctcgtattaatattggtattttctttgccattattgccattgccctaatctggttcttgcttaacaaaactactttaggttttgagattcgttcagttggtctcaacccacatgcttcagaatacgcagggatgtcatcaaaacgtactatcattttatcaatgattatctctggagctcttgcaggtcttggaggagtagttgaaggtctaggaacctttgaaaatgtttttgtacaaggatcttctttagcagttggttttgacggtatggcagttagcttattagcagcaaattcaccgcttggaatatttttctcatcattcctatttggtgtcttaaatattggtgctccaggaatgaatattgcaggcattccaccagaacttgttaaagtagtaactgcatcaatcattttctttgttggttcacattacctcattgaacgttacattattcgccctaaaaaattagtgaaaggtggtaaa

SEQ ID NO: 9172 - protein, 354 aa, Streptococcus pyogenes
MSKNAQKIAVPLISVLLGFLLGAIIMVIFGYDPIWGYEGLFQIAFGSVKNIGEIFRSMGPLILIALGFTVASRAGFFNVGLSGQALAGWISAGWFALLNPDMPRPLLILMTALIGMIAGGIAGAIPGILRAYLGTSEVIVTIMMNYIILYVGNAIVQRGYPESVKQSIDSTIQVSDNASYQTHWLSALTNNSRINIGIFFAIIAIALIWFLLNKTTLGFEIRSVGLNPHASEYAGMSSKRTIILSMIISGALAGLGGVVEGLGTFENVFVQGSSLAVGFDGMAVSLLAANSPLGIFFSSFLFGVLNIGAPGMNIAGIPPELVKVVTASIIFFVGSHYLIERYIIRPKKLVKGGK

SEQ ID NO: 9173 - DNA, 1626 bp, Streptococcus pyogenes
atgaattggtctactatttgggaacttatcaagataaacattctttattccaatccacaaagtttagctaacctcaaaaagcgtcaggaaaaacacccgaaagaaaacttcaaagcctataaaagcatgatgaggcaacaggccttaatgattgccatgtttttggtgatttacctttttatgtttattggtgtcgatttcagtcattatccaggacttttctcctttgacgttgctatgttttttatcatgtcaaccttgacagcctttagctctctttacaccattttttatgaaagtaatgacctaaaactttatattcacttaccagtaacgtcagaagaactctatattgcaaaaattgtctcgtcgctagggatgggtgctgtctttttgatgcctcttatctctcttctcttaattgcctattggcaactcttgggaaatcctttgtctattttagtagctatcgtgctctttttagtgttactagtgagttctatggtattagctatttatatcaatgcttgggtaggcaaaatcattgtaagaagtcgcaaacgaaaactcatttcaactatcatgatgtttgtctcaacttttggcgctttcgtcttaatttttgcgattaatattagtaacaacaagcgtacgatgacggatggcgtatttactgattacccaactattccctatttcaaaggattctatgatgttgttcaggcaccgttttctactgcggccctccttaacttttggttgccattgttacttatcctagctatggtatatggtattgtcacaaaagtgatgccaacttattatcgtgaggctttttatattagtaacgagaacaaagtcaagcaaactaaaaaaccagttaatcgtcctcatcagaatcaatcactggcgcagttgttgcgaaaacatcacctattaacgttacaaaatgcaactttactgacacaaacctatctcatgcccctgatgtatgtgatgctttttatcggtccaagtttgtcacgtggcacaggtttctttaagcatatttccccagattactttggggtagccttattatttggggttagtttgggtgtcatgtgtgcaacaccaaccagctttattggagtaggtatttcacttgaaaaggataactttacctttattaaaagcttaccaataacgttaaaaaaattcttgatggataaattttgcttgcttgtaggtctgcagctgattgtgcctatggtgatttatcttgtgtttggtctctttgtgttgcacctgcatcctcttctaacgattgctttttgtcttggctacgccctatcactgattgtgcaaggggaattgatgtatcgtcgtgactaccggcttctggatttaaaatggcaagacatgacgcaactctttaccagaggagatgggcaatggttaacaatgggacttatctttggtaatttaatagttgcaggtgtgctaggttttggagctgttatcattgccaatattatccaacaacctctgttgattagtattctattgagttgtctaatactaatggttttaggtcttgcgcaattatggattcaaaaaaccttctggaaaagcttagagaggctt

SEQ ID NO: 9174 - protein, 542 aa, Streptococcus pyogenes
MNWSTIWELIKINILYSNPQSLANLKKRQEKHPKENFKAYKSMMRQQALMIAMFLVIYLFMFIGVDFSHYPGLFSFDVAMFFIMSTLTAFSSLYTIFYESNDLKLYIHLPVTSEELYIAKIVSSLGMGAVFLMPLISLLLIAYWQLLGNPLSILVAIVLFLVLLVSSMVLAIYINAWVGKIIVRSRKRKLISTIMMFVSTFGAFVLIFAINISNNKRTMTDGVFTDYPTIPYFKGFYDVVQAPFSTAALLNFWLPLLLILAMVYGIVTKVMPTYYREAFYISNENKVKQTKKPVNRPHQNQSLAQLLRKHHLLTLQNATLLTQTYLMPLMYVMLFIGPSLSRGTGFFKHISPDYFGVALLFGVSLGVMCATPTSFIGVGISLEKDNFTFIKSLPITLKKFLMDKFCLLVGLQLIVPMVIYLVFGLFVLHLHPLLTIAFCLGYALSLIVQGELMYRRDYRLLDLKWQDMTQLFTRGDGQWLTMGLIFGNLIVAGVLGFGAVIIANIIQQPLLISILLSCLILMVLGLAQLWIQKTFWKSLERL

SEQ ID NO: 9175 - DNA, 1020 bp, Streptococcus pyogenes
atgacagcatcagatttacaaagggatcaatccctactggctaaaaaacgtttcagaagtggtctttatctagttcttttaattctcagcctcctatttttggcggttattgccttatcccttggtggtttggcggtttcttatggggcaattgtcaagggactgtttgtggcttatgacccccaagtggctttgatttatgatttgcgttttccaagaattgtcattgctttattagcaggagcagggatagctgtttcgggagttctttttcaagcagtgttgaaaaatcctatttcagaccctgctattatagggatttgtagtggtgctagttttatggttttagtctctagtttacttctgccgcagttgctgctgtatggtccaatcgtatcctttttaggaggcggagtgtctttcctgctgatttatggtttagcatggaagaaagggcttaatcctattcggcttattctaacagggattgctattaatgctttatttatggggttatcaactgctttaaccagctttttcacctcagctagtcccatggtcaatgctcttttagcaggtcatattagtcaaaaaacatgggctgatgtaggggttttattcccttatacattcattggcttgttactagctttgttattgtcaaaaacttgtaaccttcttcttttagatgatcaggtgattcgtcatttaggaatcgatgctacagcgttacggttgggaatttccttggttgctgttttattggcttcggtagccacttcgatcgttggagtggtttctttcctaggcttgattgtccctcatatgagccgcttgctggttggaagtaagcaccaaatcttaattcctttttcagctttgcttggagcctttgtctttttgctagccgatactttaggaagaagtcttgcttacccattggaaattagccctgcgattataatgagtattgtaggcgggccttactttatttacctgctaaggaggtctgatattata

SEQ ID NO: 9176 - protein, 340 aa, Streptococcus pyogenes
MTASDLQRDQSLLAKKRFRSGLYLVLLILSLLFLAVIALSLGGLAVSYGAIVKGLFVAYDPQVALIYDLRFPRIVIALLAGAGIAVSGVLFQAVLKNPISDPAIIGICSGASFMVLVSSLLLPQLLLYGPIVSFLGGGVSFLLIYGLAWKKGLNPIRLILTGIAINALFMGLSTALTSFFTSASPMVNALLAGHISQKTWADVGVLFPYTFIGLLLALLLSKTCNLLLLDDQVIRHLGIDATALRLGISLVAVLLASVATSIVGVVSFLGLIVPHMSRLLVGSKHQILIPFSALLGAFVFLLADTLGRSLAYPLEISPAIIMSIVGGPYFIYLLRRSDII

SEQ ID NO: 9177 - DNA, 894 bp, Streptococcus pyogenes
atgaacgaaatgcttatccttagactgatacaagctttgctagtttcggcaatgctttttattttctttatgttagtaaaacatcttaaaaaaaataagatcaatccttttaaacgcttttggacggggttttggattggcctgctaacagatgcccttgacacccttgggatagggtcttttgctactaccacaacgtgctttaagttaactaaattagtcactgacgatagacaattgcctggcactatgaccgtagctcatgtgcttccggtgctcattcaatctctttgctttatttttgtcgtaaaagttgaggttctaactttacttgctatggctgcagcagcctttattggagcttattttgggactcatattacaaaaaactggcatgctccaactgtccaacgaatccttggtagtcttttaatcatagcagctataatcatgatcattagaataatctaccatccaggagaacacctttcagacaccattcatggcctccatggcatctggctttttgttggaattggttttaattttatcgttggagtcttgatgactatggggttaggcaattatgctccagaattgattttcttttcattaatgggtcttagcccaacagttgctatgcctgttatgatgctagatgcagctatgattatgacagcttctagtagccagtttatcaaagcaaaccgtgtcagttgggatggttttgctggaattgtttctggtggtattattggcgttttactagctgtgtttttcttaacgaatttagatattaatagcttgaaacttctggtcatcgctatcgttttcttcactggtggaatgctgattcgttcctcctttacctctcataagcaacaaacaaataga

SEQ ID NO: 9178 - protein, 298 aa, Streptococcus pyogenes
MNEMLILRLIQALLVSAMLFIFFMLVKHLKKNKINPFKRFWTGFWIGLLTDALDTLGIGSFATTTTCFKLTKLVTDDRQLPGTMTVAHVLPVLIQSLCFIFVVKVEVLTLLAMAAAAFIGAYFGTHITKNWHAPTVQRILGSLLIIAAIIMIIRIIYHPGEHLSDTIHGLHGIWLFVGIGFNFIVGVLMTMGLGNYAPELIFFSLMGLSPTVAMPVMMLDAAMIMTASSSQFIKANRVSWDGFAGIVSGGIIGVLLAVFFLTNLDINSLKLLVIAIVFFTGGMLIRSSFTSHKQQTNR

SEQ ID NO: 9179 - DNA, 1341 bp, Streptococcus pyogenes
atgatgttaacgaaggggcaacttccctatagtgctgcttttacaacaggagggctcttttactttgttatcattgcattaagttattatttgggatcgacactttggctagtctttgttcaggtgttttgtttttacttatctggtttatatctttataaactcattaattatatgacaggctttcaaaaagtggctttaactttttcaattagctactatttattatctgttagtcttggttttgggggattgtatcctactcaactggctatgccatttatattaatatcggcttggtttttaactaagtattttgcctgtttagtgaaagatgaggcatttattctttttggctttgtaggtgctcttgcaatgctaattgacccgagtacccttatcttttggtcttttgcttgtgtgacagttttttcttataatataagccaaaagcatcttgcaagaggtttttatcaactgctagcttcgatttttggaatgattttagttttttacacagcaggatatttcattttgaacttacaagtgctaaatccttatttatcacaaacgatgatttatccttttactttttttaaatcaggaaacttatcgttgctttttggactggctattcagttgttcttcgctttggggcttggtcttttgacgggaatggagaatgtcattaggcgatttaaaaacaattctgatagggtcgtcaagtggctatttgtcatggtcattctagaatctatacttgtggctatattttcacaagactatcgcccctatcatcttttacctcttttaccttttggattaattttgactgctattcctgttggctatcagtatggtataggattaggtcagagtagtcatcgcagacgtcatggtaaaaatggtgttggtcgagtaatgatgatttatcttaagagacacttttatttgccaattttaattgtagggacaatactaatctgttctacttattgtttcattagtagtattcctcttaatcaggagcgtgatcatattgctagttatttagaacagaaactaaataaaactcaatctatttatgtttgggatgatacttctaaaatttatttggacagtaaagctaaatctgtttctcaatttagttctcctgacatcaatacgcaaaaagagagtcatcgaaaaatattagaagatgaactattagaaaataaggctgcttatatcgttgttaatcgctataaaaacctgcctaaaatcattcaaaaagtattatctactaattacaaagtagataaacagataacgacaaaaagttttattgtttatcagaaaaag

SEQ ID NO: 9180 - protein, 447 aa, Streptococcus pyogenes
MMLTKGQLPYSAAFTTGGLFYFVIIALSYYLGSTLWLVFVQVFCFYLSGLYLYKLINYMTGFQKVALTFSISYYLLSVSLGFGGLYPTQLAMPFILISAWFLTKYFACLVKDEAFILFGFVGALAMLIDPSTLIFWSFACVTVFSYNISQKHLARGFYQLLASIFGMILVFYTAGYFILNLQVLNPYLSQTMIYPFTFFKSGNLSLLFGLAIQLFFALGLGLLTGMENVIRRFKNNSDRVVKWLFVMVILESILVAIFSQDYRPYHLLPLLPFGLILTAIPVGYQYGIGLGQSSHRRRHGKNGVGRVMMIYLKRHFYLPILIVGTILICSTYCFISSIPLNQERDHIASYLEQKLNKTQSIYVWDDTSKIYLDSKAKSVSQFSSPDINTQKESHRKILEDELLENKAAYIVVNRYKNLPKIIQKVLSTNYKVDKQITTKSFIVYQKK

SEQ ID NO: 9181 - DNA, 831 bp, Streptococcus pyogenes
atgtttacatggggaagcattggatttgttagtaacaaaattggaggaaaaccttcgcaacaaactctaggaatgacttttggggctttattattttcattagctgtttggttaattgttagacctgagatgacactgcaactttggctttttggaatattgggtggttttatctggtcaattggtcaaactggtcaatttcatgccatgcaatacatgggagtctccgttgccaatcctttgtcaagtggctctcaacttgttctgggaagtttgattggtgtcctcgtttttcatgaatggacaagacctatgcaatttgtagtaggaagtctagcactattacttctgattgttggtttttacttttctagtaaacaagatgatgctaatgcacaagtcaatcaccttcataatttttcaaaaggatttagggcgctcacttattcaacaattggttacgtgatgtatgctgtattatttaataacatcatgaaatttgaagttttgtcagtcattttacccatggcagtaggtatggttttaggagctataactttcatgtcatttaaaatttccattgaccagtatgtgattaaaaatagcgttgttggattactttggggcattgggaatatttttatgcttttagctgcatcaaaagcaggacttgctattgcctttagtttctcacaattaggtgctatcatttcgattgtcggaggcattttattcctaggcgaaaccaaaaccaaaaaagaaatgcgttgggttgtcacaggaattatttgttttatcgtaggtgctattttattaggtgtggtcaaatct

SEQ ID NO: 9182 - protein, 277 aa, Streptococcus pyogenes
MFTWGSIGFVSNKIGGKPSQQTLGMTFGALLFSLAVWLIVRPEMTLQLWLFGILGGFIWSIGQTGQFHAMQYMGVSVANPLSSGSQLVLGSLIGVLVFHEWTRPMQFVVGSLALLLLIVGFYFSSKQDDANAQVNHLHNFSKGFRALTYSTIGYVMYAVLFNNIMKFEVLSVILPMAVGMVLGAITFMSFKISIDQYVIKNSVVGLLWGIGNIFMLLAASKAGLAIAFSFSQLGAIISIVGGILFLGETKTKKEMRWVVTGIICFIVGAILLGVVKS

SEQ ID NO: 9183 - DNA, 1506 bp, Streptococcus pyogenes
ttgttagattattatttggaatccgatattattgaccagaaaatcctactggctattttgttgacagaaaaagaactgacgatggcagcagcttgttctcaaacaactttgactgctttaaaaataaagcagtatcttcgacaatttaacgccttatttaaagggtacttacgtattgagcttattaaatctcgtatttattgtgaggtattaaatgataagcgagaagcatttttttatgacatttttgccttatcagatactctaaaaatgttgacattcttattactagataatcccaaacacaaatcaatcgctgtttatacacgaaaacaagggatatcccagtcaaaagcttatcgtcttattcataaattaaaacattatttacaagacattggtttaaatattgtagacaatactgttatcggagatgaacttaaaatacggtatttgattgctcttttacataaagagtacggcattatattatatgatatacaacctgcagacattgaaacgattcatgcttttatctttgcagcacaaaaaaacttacaaccttctgcctttttagatagacgcttcttgttttttgatgtgctgttgatgttgacttggaagcgccatcgctatcctgttcatttgcctcatttagctctttttgaacatctcaaatccttgcctatttttgacaatatcaaaaccattgccgtggatgagctagcacctcgaactcgtgtcacattttcgtctgatgattttgactatctctttttaatttatttaacgactgataactccttcttgagtgggtactggacaagtcatcagcgacaacaactttaccatttaatcaccaaagatcccgattatcatttactaatccatcgtcttcaggcactagttggaaaatattccgatattcatgagcatatccctaacttaattccttttttcaaaagaactctctacaatttacaaactttaattacctttgatggttattattttgatcaatatcaaggcaacatgctactactagataagcttgaaaccgttatcaaagattggctttatgacacaggccgtcaaggcagtattagttctggtcacttacacttgatgtgtttataccttgagcagatcttggaaagctctattgctccaatcaatattactgttattgagagccaagaaactgttggtaacgttatagctaatttcatcacctcaactatcccttcttacaaagttaaactgtcacgggtcaatatcttatctgataatatttatccctatgataaacctgtagatctggttgtaaccagtcagaagctcttgcctttcttaaaagaactcggtgtttttcccaaagagacccgcttgtttggtttgagtttggactgtatccaacagcagcgcgaagatttaatcaaaaccatcttagccttgcaccagaaccactaccaaaaacgtttagaagaactttggagagttccttct

SEQ ID NO: 9184 - protein, 502 aa, Streptococcus pyogenes
LLDYYLESDIIDQKILLAILLTEKELTMAAACSQTTLTALKIKQYLRQFNALFKGYLRIELIKSRIYCEVLNDKREAFFYDIFALSDTLKMLTFLLLDNPKHKSIAVYTRKQGISQSKAYRLIHKLKHYLQDIGLNIVDNTVIGDELKIRYLIALLHKEYGIILYDIQPADIETIHAFIFAAQKNLQPSAFLDRRFLFFDVLLMLTWKRHRYPVHLPHLALFEHLKSLPIFDNIKTIAVDELAPRTRVTFSSDDFDYLFLIYLTTDNSFLSGYWTSHQRQQLYHLITKDPDYHLLIHRLQALVGKYSDIHEHIPNLIPFFKRTLYNLQTLITFDGYYFDQYQGNMLLLDKLETVIKDWLYDTGRQGSISSGHLHLMCLYLEQILESSIAPINITVIESQETVGNVIANFITSTIPSYKVKLSRVNILSDNIYPYDKPVDLVVTSQKLLPFLKELGVFPKETRLFGLSLDCIQQQREDLIKTILALHQNHYQKRLEELWRVPS

SEQ ID NO: 9185 - DNA, 903 bp, Streptococcus pyogenes
gtgctgatgaccaaagtcagaaaagctattattcccgcagcaggtttaggcacacgttttttacctgcaaccaaggcccttgccaaggagatgctacctattgttgataaaccaactattcaatttatcgttgaagaagctctaaaatcaggtatcgaagaaattcttatcgttactggaaaatccaaacgctccatagaagatcattttgattctaattttgaattagaatataatttacaggctaaaggaaaaatcgaacttctaaagttagtagacgagaccacttctattaatcttcactttattcgacagagtcatccaagaggattaggagacgcagttcttcaagcaaagacctttgttggcaatgaaccttttgttgtcatgctaggtgatgatctgatggatattacaaatccaaatgtaaaaccattaaccaaacaattgatcgatgactatgaagaaactcatgctgcaactattgccgtcatgagggttcctcacgaggatgtctctaactacggtatcattgctcctcaagcaaaagcagtaaaaggactctatagtgtggatacttttgttgaaaaaccacaacctcaagatgcacctagtgatttggcaattattggacgttacttgctcacaccagaaatttttagtattttagaaaaacaagaacctggtgcaggcaatgaagttcaactgactgatgctattgataccctcaataagacacagcgtgtctttgctcgtgagtttaaagggaaacgctatgatgttggcgataaatttgggtttatgaaaacttctttggattatgccctgaaacaccctcaagtcaaagatgacttgaaagcctacatcatccaactgggcaaagcactagagaagacaaaacca

SEQ ID NO: 9186 - protein, 301 aa, Streptococcus pyogenes
VLMTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 9187 - DNA, 2619 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaag

SEQ ID NO: 9188 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 9189 - DNA, 879 bp, Streptococcus pyogenes
ttgctgacctttggaggtgcaagtgcggttaaggcggaagaaaatgaaaaagtaagagagcaagaaaagctcatacagcaactttctgaaaagctagtggaaattaatgacttacaaactttaaatggtgataaagagagtatacagtctctcgtagattatctgactcgaagaggaaaacttgaagaagaatggatggaatatttgaattctggtattcaacgcaaactttttgttggtccaaaaggacctgcaggtgaaaaaggagaacaaggtcctactggaaaacaaggcgagcgtggtgagaccggccctgcaggtccacgtggtgacaagggcgaaactggtgacaaaggagcccagggtccagtaggtcccgctggcaaggacggccaaaacggtaaagatggtcttccaggtaaagacggcaaggacggccaaaacggtaaagatggtcttccaggtaaagacggcaaggacggccaagacggtaaagatggcctcccaggtaaagacggtaaggatggccaaaatggcaaagatggtcttccaggtaaagacggtcaaccaggtaaaccagctcctaaaacaccagaggtccctcaaaacccagatactgcaccacatactccaaaaacccctcggatccctggtcaatcaaaagacgtgacacctgctcctcaaaacccttctaatagaggtctaaacaaaccacaaacacaaggtggtaatcagctcgcaaaaacaccggcagctcacgacacacacagacaattgccagcaacaggcgaaacaaccaatccattctttacagcagctgctgtagctatcatgacgacagctggagttgtagctgttgcaaaacgtcaagaaaacaac

SEQ ID NO: 9190 - protein, 293 aa, Streptococcus pyogenes
LLTFGGASAVKAEENEKVREQEKLIQQLSEKLVEINDLQTLNGDKESIQSLVDYLTRRGKLEEEWMEYLNSGIQRKLFVGPKGPAGEKGEQGPTGKQGERGETGPAGPRGDKGETGDKGAQGPVGPAGKDGQNGKDGLPGKDGKDGQNGKDGLPGKDGKDGQDGKDGLPGKDGKDGQNGKDGLPGKDGQPGKPAPKTPEVPQNPDTAPHTPKTPRIPGQSKDVTPAPQNPSNRGLNKPQTQGGNQLAKTPAAHDTHRQLPATGETTNPFFTAAAVAIMTTAGVVAVAKRQENN

SEQ ID NO: 9191 - DNA, 882 bp, Streptococcus pyogenes
atgataaaacgatgtaaaggaattggtctagccttaatggccttctttttggtagcttgtgtgaatcagcaccctaaaacggctaaagagactgaacagcagagaattgtagccacttcggttgctgtggttgatatctgtgaccgtttaaatttagacctcgttggggtttgtgatagtaaattatatacccttcctaaacgctatgatgctgttaagcgtgtgggtttacccatgaatcctgatatagagttgattgcttctttgaaaccaacttggattttgagtcccaattctttacaagaagatttggaacccaagtatcaaaaattggatactgagtatggttttttgaacttacgaagtgttgagggcatgtaccagtccattgatgatttagggaaccttttccaacgtcaacaagaagcaaaagaattgcgccagcaataccaggactattatcgtgctttccaagctaaacgtaaggggaagaaaaagcctaaagtgcttattcttatgggcttgccaggtagttatttggtggcgacgaaccaatcttatgtagggaatcttttggacttggcaggtggtgagaatgtttatcagtcagatgagaaagaatttctatcagctaatcctgaagacatgctggctaaggagcctgacttgattttacgaacagctcatgccattccagacaaggtaaaagtgatgtttgacaaagaatttgctgaaaatgatatttggaaacattttacggcagtcaaggaagggaaagtctatgatttggacaataccctgtttggcatgagtgctaaattgaactacccagaagccttggacaccttaacacagctttttgaccacgtgggagatcatccg

SEQ ID NO: 9192 - protein, 294 aa, Streptococcus pyogenes
MIKRCKGIGLALMAFFLVACVNQHPKTAKETEQQRIVATSVAVVDICDRLNLDLVGVCDSKLYTLPKRYDAVKRVGLPMNPDIELIASLKPTWILSPNSLQEDLEPKYQKLDTEYGFLNLRSVEGMYQSIDDLGNLFQRQQEAKELRQQYQDYYRAFQAKRKGKKKPKVLILMGLPGSYLVATNQSYVGNLLDLAGGENVYQSDEKEFLSANPEDMLAKEPDLILRTAHAIPDKVKVMFDKEFAENDIWKHFTAVKEGKVYDLDNTLFGMSAKLNYPEALDTLTQLFDHVGDHP

SEQ ID NO: 9193 - DNA, 951 bp, Streptococcus pyogenes
atgagaaaagaggctcaaaaggacatgaaacaaatgaataaactcattacaggagtggtaacgctggcgacagtcgtgaccttatcagcttgtcaatcatcacacaacaacaccaaactcgtctcgatgaaaggagacaccatcactgtcagtgacttctacaatgagaccaaaaacacagaactcgcacaaaaagccatgttaagcttggtgattagccgcgtttttgagacacaatatgccaacaaagtctctgacaaagaggttgaaaaagcctataaacaaaccgcagaccaatacggtacatcctttaagacagtcctagcacaatcaggcttaacgccagaaacctataaaaaacaaattcgcctcacaaaattagtcgaatatgccgtcaaagaacaagccaaaaacgaaaccatctcaaaaaaagactaccgtcaggcctatgacgcttataccccaaccatgaccgcagaaatcatgcagtttgaaaaagaagaggatgccaaagcagcgcttgaagccgtcaaagctgaaggggcagactttgcagctattgccaaagaaaaaaccactgcagccgataaaaaaacaacctatacgtttgactcaggcgaaacaaccctaccagcagaagtagttagagctgcatcaggcctcaaagaagggaacagatcagaaatcatcacagcgcttgatccagccacctcaaaacgcacctaccatatcatcaaagtcaccaaaaaagcaactaaaaaagcagactggaaagcgtaccaaaaacgcttgaaagacatcatcgtgactggcaaattaaaagaccctgacttccaaaacaaagtcatcgctaaagctcttgataaagcaaatgtcaaaatcaaagacaaagcatttgccaatatcttagcccagtttgcaaaacctaaccaaaaacaacctgcccaaaaa

SEQ ID NO: 9194 - protein, 317 aa, Streptococcus pyogenes
MRKEAQKDMKQMNKLITGVVTLATVVTLSACQSSHNNTKLVSMKGDTITVSDFYNETKNTELAQKAMLSLVISRVFETQYANKVSDKEVEKAYKQTADQYGTSFKTVLAQSGLTPETYKKQIRLTKLVEYAVKEQAKNETISKKDYRQAYDAYTPTMTAEIMQFEKEEDAKAALEAVKAEGADFAAIAKEKTTAADKKTTYTFDSGETTLPAEVVRAASGLKEGNRSEIITALDPATSKRTYHIIKVTKKATKKADWKAYQKRLKDIIVTGKLKDPDFQNKVIAKALDKANVKIKDKAFANILAQFAKPNQKQPAQK

SEQ ID NO: 9195 - DNA, 1533 bp, Streptococcus pyogenes
atgtctgtgaaagcgttatcgtttactaggaggattcgcatgataaacaaaaaaatatcacttggagttttaagtattctgacagccttttcgcttcaaagtgttagttatgcttgtactggttttattattggcaaagatttaaccaaagacggttctcttctttatggtcgaacagaagatcttgagccacaccataataaaaatttcattgtacgtctagcaaaggacaatcctgctggcgaaaaatggaaagacctctctaatggttttgagtaccccttgcctgagcattcttatcgctatagtgcgattcctgatgtaacacctaacaaaggcgtttatgacgaagctggttttaatgagtttggcgtctctatgtctgcaacagtatcagcttcagctaatgatgccatccaaaaaattgatccttacgtcaaaaatggcttagcggaatcatctatgaccagtgtcattttaccaagtgtcaaaacagcccgtgaaggtgtcgcattgatcgctaaaatagtcactgaaaaaggagctgctgaaggaaatattgttaccttggctgacaaagacggcatctggtacatggaaattctctctggtcaccaatacgttgccatcaaattcccagatgataaatacgctgtttttccaaataccttctatctcggacatgtcgatttcaatgataaggaaaatacgattgcctcagaagatgtggaaaaagtcgctaaaaaagccaaatcttataccgaagttgatggtaaatttcatattgccaaatcttacaatccaccactaaacgatgccaaccgctctcgctctttctcagggattaaatcacttgaccctgattcaaaagtaacttataaagacagcaattatgagttgctccaaagcactgataagaccttcagtctagaagatgcgatgaaactgcaacgtaatcgttttgaggggctggatcttaaaccacttgatcagatggcattagacggtaagggtaaaccaaaatccaaaaaagctgttaaaggttatgcttatcccatatcaaatcctaatgtcatggaagctcatattttccaactgaaaaaagacatccctgctgaattgggtggtgtcatgtggctatctattggcagtcctcgtaatgccccttacttgccataccttggcaatatcagtagaacctatgaagcctatcaagaaaaaagcacccaatataacgataagtcatggtattggacggtgtcacacattaatgatctcgtggctgctcatccaaaaccatttggaactaaagtgattgatgagatgaaaggcttggaaaaaacctggatagccgaacaagacaaaagcaccaaagaaatcagtgacttagtcgtcagtgaccccaaagctgctcaagaaaaagctgataagatttcactagatcgcgctgaaaaaaccttcaaacgcttaaaagctattgaagccaagttggttaaagaaaaacccaaaaacaagaaaggcttgaatagatca

SEQ ID NO: 9196 - protein, 511 aa, Streptococcus pyogenes
MSVKALSFTRRIRMINKKISLGVLSILTAFSLQSVSYACTGFIIGKDLTKDGSLLYGRTEDLEPHHNKNFIVRLAKDNPAGEKWKDLSNGFEYPLPEHSYRYSAIPDVTPNKGVYDEAGFNEFGVSMSATVSASANDAIQKIDPYVKNGLAESSMTSVILPSVKTAREGVALIAKIVTEKGAAEGNIVTLADKDGIWYMEILSGHQYVAIKFPDDKYAVFPNTFYLGHVDFNDKENTIASEDVEKVAKKAKSYTEVDGKFHIAKSYNPPLNDANRSRSFSGIKSLDPDSKVTYKDSNYELLQSTDKTFSLEDAMKLQRNRFEGLDLKPLDQMALDGKGKPKSKKAVKGYAYPISNPNVMEAHIFQLKKDIPAELGGVMWLSIGSPRNAPYLPYLGNISRTYEAYQEKSTQYNDKSWYWTVSHINDLVAAHPKPFGTKVIDEMKGLEKTWIAEQDKSTKEISDLVVSDPKAAQEKADKISLDRAEKTFKRLKAIEAKLVKEKPKNKKGLNRS

SEQ ID NO: 9197 - DNA, 1197 bp, Streptococcus pyogenes
atgtttacaaaaacgcaggaagctttggaggctcttggtgcagctatcactaccaaggaaattaaacaagaaccccgtttatggcaagaaaccatgacgttttttgaagaaacaagagattctctggattcttttttaaagagagtttgtaacagcgctaacagaaataacgttcatgtcatctttacaggtgcgggtacatctgagtacatcggtaataccatttgcccttacttgaagaaggtggggaatcggcagcgctatctctttgagagcgttgcttcaaccgatttggttgcggcgccagattattatcttgttgaggaagagacggtactattagtctcctttgctaggagtggtaatagtccagaaagtgtagcggctgttaacctggtcaatcaactagtgccaaatagttatcatttaaccattacctgcgccaaagatggagaactggcgaaaaaagcacagcaagatgagcgttcttacctttatttgatgcctgaagacgctaatgatgctggttttgccatgactggtagttttacctgtatgatgctagcggctcttttgatttttgatgatgctaacagtatagctcagaaagaagcttatgtgactgatatgattcttgctgggcaagctgttattgaccaagaaagacggctacaagagctagctgatttaggatttgaacgtttagtttatctaggttctgctggtttagccaagttaacccaagaagctcaattaaaaatgttagaattgacagctggacaagttgcgaccctctacgagtcctttatgggctttaggcatggtccgaaatcttttattaatgaccgtaccttagtcattggatttgtcaataatgatgcttacgtcagacagtacgatttggacatgttagaggaaatccaagcagatggcattgcccttaaaatcttggctctattgcaaggaggggatatcaacttttcagaggaccaatttcgactagacacccgtcacttattgccagacgcttacttagcttttcccatgattttagtcgcgcagaccttggccctcttaacggccgttacattaggaaattcccctgacaccccatctgcgacaggaacggttaatcgtgtggtcaaaggagtaacgattcacccttacccgactagtagtcgtcaatgcaacaaagct

SEQ ID NO: 9198 - protein, 399 aa, Streptococcus pyogenes
MFTKTQEALEALGAAITTKEIKQEPRLWQETMTFFEETRDSLDSFLKRVCNSANRNNVHVIFTGAGTSEYIGNTICPYLKKVGNRQRYLFESVASTDLVAAPDYYLVEEETVLLVSFARSGNSPESVAAVNLVNQLVPNSYHLTITCAKDGELAKKAQQDERSYLYLMPEDANDAGFAMTGSFTCMMLAALLIFDDANSIAQKEAYVTDMILAGQAVIDQERRLQELADLGFERLVYLGSAGLAKLTQEAQLKMLELTAGQVATLYESFMGFRHGPKSFINDRTLVIGFVNNDAYVRQYDLDMLEEIQADGIALKILALLQGGDINFSEDQFRLDTRHLLPDAYLAFPMILVAQTLALLTAVTLGNSPDTPSATGTVNRVVKGVTIHPYPTSSRQCNKA

SEQ ID NO: 9199 - DNA, 864 bp, Streptococcus pyogenes
atgaaacggattgttgtggcaaatgatctggttggtgttggtaaggtagccttgtctgctagtattcctttaatggcttcttgtttgttagagcaagttttattaccaacttgccttttatcaagccatactggcggaggacagaaccctgtgaagcatactacatcaagtatattagacgtttttttaacagattgggacaacaaaagaattaagtttgacggcatttttataggttattttacgacaacaagagatgggcaaaagctgctagaatggctttcaagaaagcaacttcccttaattttagatccaattatggcagataatggaaaactttatcaaggcttcagtcaaaaacatatagagattatgataaaacttactcaaaaagctgagcttgttttacctaatattagtgaggcttgtctattaacacaaacagcttatttagcaaaaaattatgatgaagaagatattagacaggtggctagaaaattagctaagcttggacctaaacaggttgtcattagcggaatctcttttgaggagggcagcattggttttgcttactatcagtcagattcagatcaattaacattccattttgggaagcaattcccttaccatttctatggtacaggagatatagcatcagctattataacagcaggattctattatcagctaccactaacacaaattctagatcttgttgtttcatttcttgaaaaagtattgcaaaatacccttacattaaaaagagatttaatcttaggtgttgcttatgaatctcatttaaattacttaactaaatcgtttaaaaagttgttggaggaaaaaaatgtcatctcaaaaattagc

SEQ ID NO: 9200 - protein, 288 aa, Streptococcus pyogenes
MKRIVVANDLVGVGKVALSASIPLMASCLLEQVLLPTCLLSSHTGGGQNPVKHTTSSILDVFLTDWDNKRIKFDGIFIGYFTTTRDGQKLLEWLSRKQLPLILDPIMADNGKLYQGFSQKHIEIMIKLTQKAELVLPNISEACLLTQTAYLAKNYDEEDIRQVARKLAKLGPKQVVISGISFEEGSIGFAYYQSDSDQLTFHFGKQFPYHFYGTGDIASAIITAGFYYQLPLTQILDLVVSFLEKVLQNTLTLKRDLILGVAYESHLNYLTKSFKKLLEEKNVISKIS

SEQ ID NO: 9201 - DNA, 651 bp, Streptococcus pyogenes
atgggaaaagaaataaaagtgaaatgctttttgcgtagatcagcttttggattagttgcggtgtcagcatcagtattagtcggttcaacagtatctgctgttgactcacctatcgaacagcctcgaattattccaaatggcggaaccttaactaatcttcttggcaatgctccagaaaaactggcattacgtaatgaagaaagagccattgatgaattaaaaaaacaagctattgaggataaagaagctacgacagctatagaagcagcaagttcagatgccttagaagcattagcggatcaaacagacgctttacaatcagaagaagctgcggttgttaaagcggataacgctgctagtgacgccttagaagcattggcggatcaaacagacgctttacaatcagaagaagctgaagtagttcaatcagataacgctgctagtgacgcctgggaaaaagcagcaactccaatcgctttagatgttaagaaaactaaagatacaaaacctgtagttaaaaaagaagaaagacaaaacgttaatacccttcctacaactggtgaagagtctaacccattctttacagctgctgcgcttgcaataatggtaagtacaggtgtgttagttgtaagttcaaagtgcaaagaaaat

SEQ ID NO: 9202 - protein, 217 aa, Streptococcus pyogenes
MGKEIKVKCFLRRSAFGLVAVSASVLVGSTVSAVDSPIEQPRIIPNGGTLTNLLGNAPEKLALRNEERAIDELKKQAIEDKEATTAIEAASSDALEALADQTDALQSEEAAVVKADNAASDALEALADQTDALQSEEAEVVQSDNAASDAWEKAATPIALDVKKTKDTKPVVKKEERQNVNTLPTTGEESNPFFTAAALAIMVSTGVLVVSSKCKEN

SEQ ID NO: 9203 - DNA, 1104 bp, Streptococcus pyogenes
atggaacataaatggaaattatggctatttatcgttggagtggtcttgttaataggcggagcttctgttctcattcagaaaggtcaagccaaggcttttagtcaaggcaagcctcaactaccagctaaaaaagtcaaatccactaaagtagatcccaatgcccctgttgatcaaaaagtgatttacctggctggaggctgtttctggggcgttgaagaatatttttcacaagtggatggcgttctagatgcggtgtcaggctatgccaatggtagaggcgataccaccaactaccagttaattcatcagactggtcatgcagaaaccgttgaagtggcctatgatgcgaaccgtattagcttgaaagaattattactgcattttttccgaattattgacccaaccagtcttaataagcaaggaaatgatcgcggtagtcaataccgaactgggatttactatactgacaaagcagatttagctattattgatgaggtcttcaaagaaaaagctaaggattacaagaaaaaaatagtggttgaaaaagcaccattgaaacactttattaaggcagaagactaccaccaagattacctcaagaaaaatccaaatggctactgccatattgacatcaaccaagcgacttatcctgtgattgatgaaagcaagtacccaaaaccaagtgccactgagatcaaggaaaaactatctgcagacgaataccgagtgacgcaaaaaaacgaaactgaaaaagctttttctaatcgctactgggattcttttgatgcaggaatttacgtagacgttgtgacaggagaaccgcttttctcttcaaaagacaaatttgaatcaggttgtggttggccaagctttagccgccccatcagcccagacgttgtccgctacaaggaagataagagtttcaatatgacgagaacagaagtgcgcagccgttcagggaattctcatctggggcatgtctttactgacggacctaaagaccaaggcggccttcgttactgcatcaatagcttgtctattacctttattccaaaagctgatatggaagctaagggctatgggtatttattatcatctgtagaa

SEQ ID NO: 9204 - protein, 368 aa, Streptococcus pyogenes
MEHKWKLWLFIVGVVLLIGGASVLIQKGQAKAFSQGKPQLPAKKVKSTKVDPNAPVDQKVIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 9205 - DNA, 1452 bp, Streptococcus pyogenes
atggctaaaaataacacgaatagacactattcgcttagaaaattaaaaacaggaacggcttcagtagcggtagctttgactgttttaggggcaggttttgcgaatcaaacagaggttaaggctaacggtgatggtaatcctagggaagttatagaagatcttgcagcaaacaatcccgcaatacaaaatatacgtttacgttacgaaaacaaggacttaaaagcgagattagagaatgcaatggaagttgcaggaagagattttaagagagctgaagaacttgaaaaagcaaaacaagccttagaagaccagcgtaaagatttagaaactaaattaaaagaactacaacaagactatgacttagcaaaggaatcaacaagttgggatagacaaagacttgaaaaagagttagaagagaaaaaggaagctcttgaattagcgatagaccaggcaagtcgggactaccatagagctaccgctttagaaaaagagttagaagagaaaaagaaagctcttgaattagcgatagaccaagcgagtcaggactataatagagctaacgtcttagaaaaagagttagaaacgattactagagaacaagagattaatcgtaatcttttaggcaatgcaaaacttgaacttgatcaactttcatctgaaaaagagcagctaacgatcgaaaaagcaaaacttgaggaagaaaaacaaatctcagacgcaagtcgtcaaagccttcgtcgtgacttggacgcatcacgtgaagctaagaaacaggttgaaaaagatttagcaaacttgactgctgaacttgataaggttaaagaagacaaacaaatctcagacgcaagccgtcaaggccttcgccgtgacttggacgcatcacgtgaagctaagaaacaggttgaaaaagatttagcaaacttgactgctgaacttgataaggttaaagaagaaaaacaaatctcagacgcaagccgtcaaggccttcgccgtgacttggacgcatcacgtgaagctaagaaacaagttgaaaaagctttagaagaagcaaacagcaaattagctgctcttgaaaaacttaacaaagagcttgaagaaagcaagaaattaacagaaaaagaaaaagctgaactacaagcaaaacttgaagcagaagcaaaagcactcaaagaacaattagcgaaacaagctgaagaacttgcaaaactaagagctggaaaagcatcagactcacaaacccctgatacaaaaccaggaaacaaagctgttccaggtaaaggtcaagcaccacaagcaggtacaaaacctaaccaaaacaaagcaccaatgaaggaaactaagagacagttaccatcaacaggtgaaacagctaacccattcttcacagcggcagcccttactgttatggcaacagctggagtagcagcagttgtaaaacgcaaagaagaaaac

SEQ ID NO: 9206 - protein, 484 aa, Streptococcus pyogenes
MAKNNTNRHYSLRKLKTGTASVAVALTVLGAGFANQTEVKANGDGNPREVIEDLAANNPAIQNIRLRYENKDLKARLENAMEVAGRDFKRAEELEKAKQALEDQRKDLETKLKELQQDYDLAKESTSWDRQRLEKELEEKKEALELAIDQASRDYHRATALEKELEEKKKALELAIDQASQDYNRANVLEKELETITREQEINRNLLGNAKLELDQLSSEKEQLTIEKAKLEEEKQISDASRQSLRRDLDASREAKKQVEKDLANLTAELDKVKEDKQISDASRQGLRRDLDASREAKKQVEKDLANLTAELDKVKEEKQISDASRQGLRRDLDASREAKKQVEKALEEANSKLAALEKLNKELEESKKLTEKEKAELQAKLEAEAKALKEQLAKQAEELAKLRAGKASDSQTPDTKPGNKAVPGKGQAPQAGTKPNQNKAPMKETKRQLPSTGETANPFFTAAALTVMATAGVAAVVKRKEEN

SEQ ID NO: 9207 - DNA, 1266 bp, Streptococcus pyogenes
atgtttcagttaagaaaaaaaatgacgcgcaaacaattagccttgttgagtgctggagtgttgacctgtgtggttggtggtagctacttgataatgaaccatcaacaacaagaaattgtctctagtgtcaacaaagtaaaagccttaaccataaaagaagccatggaacaaggaaaagatatcagcttgaccttagctggcgaagtaacagctaacaacagcagcaaagtcaaaatcgactcaagtaaaggagaagtcaaagaggtctttgttaaaaaaggcgatgttgtcaaagtaggacaacccttgtttagctatgaaacgtcacagcggttaacggctcaaagttcagaatttgatgttcaaaccaaagccaatcagctccaagttgctaaaaccaatgcagcattgaagtgggaaacctacaatcgcaaggtcaatgaaatcaacaccctaaaatctcgctacaacactgcaccagatgagagcttactagagcaaattcgcagcgcagaagacagtgtatcccaagcactaagcgatgccaaaacagcagatagcgatgtcaaaaccgctcaaatcgaactcgataaagctaatgctactgccacaacggaaaaaggtaaactagagtatgacaccgttaagtcagacaccgcaggaaccattgttagtctaaatactgatttgccaaatcaatcaaaatccaaaaaagaaaatgaaacttttatggaaattatcgacaaatcaaaaatgttagtcaaaggtaacattagtgaatttgaccgtgacaagttaaaaatcggtcaaaaagtcgaagtgattgaccgcaaagacaactctaaaaaatggactggaaaagtaacccaagttggcaacctcaaagcagaggaaaaaggccaaggtcaaggccaaggtggcaatgaccaacaagataatccaaaccaagcaaaattcccttatgttattgaacttgaccaatcagacaagcagccactcattggctcacacacctatgttaatgtgctcaacaatgttccagaagctggcaagatcgtattgaaagaaacctttacaatggcagaaaatggaaaaacctatgtgtggaaagttgataaaaacaaggtcaaaaaacaagaaatcaagactaagcccttctcaaaaggttatgttgaggtaacaagtggcttgactatgcaagataagattgctcagccgcttcctggcatgaaagacggtatggaggtaggaagtattgttaaacct

SEQ ID NO: 9208 - protein, 422 aa, Streptococcus pyogenes
MFQLRKKMTRKQLALLSAGVLTCVVGGSYLIMNHQQQEIVSSVNKVKALTIKEAMEQGKDISLTLAGEVTANNSSKVKIDSSKGEVKEVFVKKGDVVKVGQPLFSYETSQRLTAQSSEFDVQTKANQLQVAKTNAALKWETYNRKVNEINTLKSRYNTAPDESLLEQIRSAEDSVSQALSDAKTADSDVKTAQIELDKANATATTEKGKLEYDTVKSDTAGTIVSLNTDLPNQSKSKKENETFMEIIDKSKMLVKGNISEFDRDKLKIGQKVEVIDRKDNSKKWTGKVTQVGNLKAEEKGQGQGQGGNDQQDNPNQAKFPYVIELDQSDKQPLIGSHTYVNVLNNVPEAGKIVLKETFTMAENGKTYVWKVDKNKVKKQEIKTKPFSKGYVEVTSGLTMQDKIAQPLPGMKDGMEVGSIVKP

SEQ ID NO: 9209 - DNA, 813 bp, Streptococcus pyogenes
atgaatctacttggatcaagacgggttttttctaaaaaatgtcggctagtaaaattttcaatggtagctcttgtatcagccacaatggctgtaacaacagtcacacttgaaaatactgcactggcacgacaaacacaggtctcaaatgatgttgttctaaatgatggcgcaagcaagtacctaaacgaagcattagcttggacattcaatgacagtcccaactattacaaaaccttaggtactagtcagatcactccagcactctttcctaaagcaggagatattctctatagcaaattagatgagttaggaaggacgcgtactgctagaggtacattgacttatgccaatgttgaaggtagctacggtgttagacaatctttcggtaaaaatcaaaaccccgcaggctggactggaaaccctaatcatgtcaaatataaaattgaatggttaaatggtctatcttatgtcggagatttctggaatagaagtcatctcattgcagatagtctcggtggagatgcactcagagtcaatgccgttacagggacacgtacccaaaatgtaggaggtcgtgaccaaaaaggcggcatgcgctataccgaacaaagagctcaagaatggttagaagcaaatcgtgatggctatctttattatgaagctgctccaatctataacgcagacgagttgattccaagagctgtcgtggtatcaatgcaatcttctgataataccatcaacgagaaagtattagtttacaacacagctaatggctacaccattaactaccataacggtacacctactcagaaa

SEQ ID NO: 9210 - protein, 271 aa, Streptococcus pyogenes
MNLLGSRRVFSKKCRLVKFSMVALVSATMAVTTVTLENTALARQTQVSNDVVLNDGASKYLNEALAWTFNDSPNYYKTLGTSQITPALFPKAGDILYSKLDELGRTRTARGTLTYANVEGSYGVRQSFGKNQNPAGWTGNPNHVKYKIEWLNGLSYVGDFWNRSHLIADSLGGDALRVNAVTGTRTQNVGGRDQKGGMRYTEQRAQEWLEANRDGYLYYEAAPIYNADELIPRAVVVSMQSSDNTINEKVLVYNTANGYTINYHNGTPTQK

SEQ ID NO: 9211 - DNA, 1233 bp, Streptococcus pyogenes
atgataaaaaggtgggttatccttttttttatggtattaacttgttcagggtttggtaaaacagttctcgcagctgattttcaagtgggagcagaacatgcgattgtcgtagaggcagactctgggagagttctgtatgagaaagacgctaagacgccagatgctattgcctctttgaccaaattggtgacggcttatctggttttagataaggttaaatcaggccagctgcaattatcagatcaagttaatctctcagattatgccttcgagttaacaaaagataggtctttaagtaatgtaccttttgacaaaaaaacttattcagttcaagacctgttgacagctactttggtagcaagctcaaatagcgctgctattgcgttagccgaaaaagtggcgggctcagagcttcattttgtaaatcaaatgagagaacagctatctcattgggggattacttctggtaaaatcctcaacgcttcaggactgccgaatgaggtgctaaaggaccatcgttatcctggttctgcgttggaagaagagaatatgttgagtgctcaggatgttgccattgtgacgatgcatttactggaagattttcctgagattttagagatcactaaacaaacagaagttgattttgctggtaattctattaaaagttttaatcaactcttaccaggtatggctaagggtagagcaggagtggatgggctaaagacaggaacgacagatttggcaggtcattgccttgtggtaacttctattgaaaatggtatgaggctgattaccgttattctaaatgctgatggatctgataaaaaccaaaacacgcggtttgagcaagcaaatcgcttgttggactatgtggctagaacttattgtcgtcgtaagattcttaaaaaaggaagtcttgtctcggagcgatcgctccctattcaagatggccaagtaaaagaactaccgatatctgttgccgaagatgtaaccatcattttgcaacagggtgaacaagttcccaaacctaaacaatttatgatatcagagacttctttattagcaccgattactaaaggtgaagtggttgcttatttgacgtctccaagaataacagatcagtcagtgaggtatttaaaggaacctaagcgtattcctcttaaagctagccaatctctaaaaaaagcctctgacttacagctgtggtggcgagattttcttgaaaaaagacgt

SEQ ID NO: 9212 - protein, 411 aa, Streptococcus pyogenes
MIKRWVILFFMVLTCSGFGKTVLAADFQVGAEHAIVVEADSGRVLYEKDAKTPDAIASLTKLVTAYLVLDKVKSGQLQLSDQVNLSDYAFELTKDRSLSNVPFDKKTYSVQDLLTATLVASSNSAAIALAEKVAGSELHFVNQMREQLSHWGITSGKILNASGLPNEVLKDHRYPGSALEEENMLSAQDVAIVTMHLLEDFPEILEITKQTEVDFAGNSIKSFNQLLPGMAKGRAGVDGLKTGTTDLAGHCLVVTSIENGMRLITVILNADGSDKNQNTRFEQANRLLDYVARTYCRRKILKKGSLVSERSLPIQDGQVKELPISVAEDVTIILQQGEQVPKPKQFMISETSLLAPITKGEVVAYLTSPRITDQSVRYLKEPKRIPLKASQSLKKASDLQLWWRDFLEKRR

SEQ ID NO: 9213 - DNA, 1257 bp, Streptococcus pyogenes
atgtcatggaattggaaaaaaacatctgtgcttggaactttatccttagcttcagtgctacccctaactgcttgcgtaagtggtggtggtaaaggcgttaaggaaacagacggaaagactattgtagtctctgttgatgagggatatgttgattacattaagagtattaagggtgagtttgaaaaagaacataaagtcaccgttaaagtcaaaaaagaaggtatgatggatactcttgataagctatcaacggatggtccaacaggagcttcaccagatgtctttttagcaccttttgaccgtgtaggtggtttaggaactgaaggtcaaatcgctgaggttactttaggaaacagcaaagagtttgatgatacggttaagaaattagtaaccattgatggtaaaacttatggtgcaccagacgtaattgaaactttggtaacttattataataaggatttagtgcctcaagcacctaaaagctttactgaattagaagtcttacaaaaagattctaagtttgcttttgcctctgaaccaggaaaatctgtaggtttcttggcgaaatggacagacttctattatggttatggtttaattgccggttatggcggttatatctttggtgataaaggaaccaaaccaagtgatttaggcctaggtaacgacggaactgttgaagggttaaactacgcgaaacagtggtatggcacttggcctcaaggaatgcaagacactaaaaaagctggtgattttatcactgaacaatttatttctaaaaaagctggtgtcattattgatggtccatgggcagctagctcctttaaagatgctggtgttaactttggggtaatggaaattcctactttgacaaatggtaaaaaataccaaccgttcgcaggtggtaaagcttgggttatttcaaactattctaaaggaaaaacgactgctcaaaaattccttgattatgtgaccaatgctgaaaaccaaaaacgtttctatgataaaacacaagaaattccagctaacttaacagcacgtaactatgcttctaaagagggtaatgagttaacgaaagctgtgattagtcagtttgagagcgcacaaccaatgccaaatattccagaaatggctgaagtttgggaaccaggtgcaaatatgttctttaacgtggcttctggtaaggaagaagcatctaaagctgcaaaagaagcagcaaaaactattaaggaagctattgaacaaaaatacgctgaa

SEQ ID NO: 9214 - protein, 419 aa, Streptococcus pyogenes
MSWNWKKTSVLGTLSLASVLPLTACVSGGGKGVKETDGKTIVVSVDEGYVDYIKSIKGEFEKEHKVTVKVKKEGMMDTLDKLSTDGPTGASPDVFLAPFDRVGGLGTEGQIAEVTLGNSKEFDDTVKKLVTIDGKTYGAPDVIETLVTYYNKDLVPQAPKSFTELEVLQKDSKFAFASEPGKSVGFLAKWTDFYYGYGLIAGYGGYIFGDKGTKPSDLGLGNDGTVEGLNYAKQWYGTWPQGMQDTKKAGDFITEQFISKKAGVIIDGPWAASSFKDAGVNFGVMEIPTLTNGKKYQPFAGGKAWVISNYSKGKTTAQKFLDYVTNAENQKRFYDKTQEIPANLTARNYASKEGNELTKAVISQFESAQPMPNIPEMAEVWEPGANMFFNVASGKEEASKAAKEAAKTIKEAIEQKYAE

SEQ ID NO: 9215 - DNA, 1218 bp, Streptococcus pyogenes
atgaaattacttggaaaatggctattcttcttgatgtttctgactttttgcgtcagtttttggcagaaagactatcagcggattgcctttgaaaaagaacacaaactttatcaagatttagtggcacctttttaccaaaactatcctaaattacgagaactccagctttcagaagctattaaattacgccacgacttgcttgattatgttcgaaagctcgataaggacggatggtcctataaagccatccaaaaaggataccttgaacaactcgctgttagaggaaactcttatcatttcgaacaactttatagtcgcattcgcctgataggatcacctgactttcaaaagctctggcaacaagaggagatggcacagacgcctcaagaagctcaaaaacggttacaactgctcttgacgtatttaaagatgccagacgagttgacaggacaatcaaaacaaacacagcaagtattggcacaattaagtccaaagctatcgccaacagatcctttttgggaccaattatctaccctgattcaggcttattatgttaatctcgaacacattccttatagccgttttaatcggaaaattcatcaactccgttacctcatatcaacccagcaaacggagtgggttcgctcacattatgggaataaagggaaaaccgatgcggatgccttagccaaatatttggctactctagaagatgacgattatgctctttatgaatcttctagataccataataaggttgctagtattttagatgctaatggcaatcatcaggcagtctatacagacaatattcctcaagccaactataagattttaattcattttcactcagagtttattttgtcagaatctggacaatttttagtagcactagatcctgataacctaacgcgaaatagtattgtcaatggttcttctttcaattatggcaaccaaaacgatgacttgcaccgtctgcttgatattgaccctattctgctttttgatccggcttttattgaaaaagcaattaatagtcctgatgcaacttttctagttcccgatttagaacagcaaagggataagcacaatcccatttacagcagaaatggcaaatcatctaagcagctaacacgcgctgccgttaaaaaattcaaaaaattgcttcaccattatcaagaaacaagaggtgacaataagacctcaaaaacacagcat

SEQ ID NO: 9216 - protein, 406 aa, Streptococcus pyogenes
MKLLGKWLFFLMFLTFCVSFWQKDYQRIAFEKEHKLYQDLVAPFYQNYPKLRELQLSEAIKLRHDLLDYVRKLDKDGWSYKAIQKGYLEQLAVRGNSYHFEQLYSRIRLIGSPDFQKLWQQEEMAQTPQEAQKRLQLLLTYLKMPDELTGQSKQTQQVLAQLSPKLSPTDPFWDQLSTLIQAYYVNLEHIPYSRFNRKIHQLRYLISTQQTEWVRSHYGNKGKTDADALAKYLATLEDDDYALYESSRYHNKVASILDANGNHQAVYTDNIPQANYKILIHFHSEFILSESGQFLVALDPDNLTRNSIVNGSSFNYGNQNDDLHRLLDIDPILLFDPAFIEKAINSPDATFLVPDLEQQRDKHNPIYSRNGKSSKQLTRAAVKKFKKLLHHYQETRGDNKTSKTQH

SEQ ID NO: 9217 - DNA, 900 bp, Streptococcus pyogenes
atgacacagcaatcaatgttactaagtattgagcaagtaaataaatcctatggtaaaaatcaggttttaagtgatatctcttttgatatttacaaaggagaaatttgcggccttgtgggtcaaaatggtgctggaaagacaacgttaatgcgtattttatctggcctaattggaaaagattcagggcaaatcaaacagttacaaccctatcgaatgggatcaattattgagtcaccgacactttatcccaatatgacagctcatgataatctttactatgcagcgttgcaattgagattagctgatgcaaaagagcgcatacatgaggttttggaacttattgggttagaaaaagtgagcaaaaagaaaaaggtgaaagattattctttagggatgcgccaacgtttggctattggtctttcgatactggattttccagaatttttaatcttggatgaacccattaatggtcttgatccagcaggaatcaaagaaatgcgtcagattattttgaacctaagagattgctatggtattacgattttgatttccagtcatattttatcagaattagacttagttgttgatcgttacgtgattatgcataaaggcaaagttattaagagtatggacaaagcagagcttaaagctcaagtaaaagtacaaattgcccttcatacaagcgatgatcagctggtaaaaaatagacttttagaattggggcttagagttgagactgatggtcagatgctactaataaaaccaactttatcagtaatggagcttatcaaaattgttctagatctgcctgttgagatttttgacatttatcatcatcaagtgagctttgaacattattacctcgatttgttaggtaaagatgcagcatcaccattaatt

SEQ ID NO: 9218 - protein, 300 aa, Streptococcus pyogenes
MTQQSMLLSIEQVNKSYGKNQVLSDISFDIYKGEICGLVGQNGAGKTTLMRILSGLIGKDSGQIKQLQPYRMGSIIESPTLYPNMTAHDNLYYAALQLRLADAKERIHEVLELIGLEKVSKKKKVKDYSLGMRQRLAIGLSILDFPEFLILDEPINGLDPAGIKEMRQIILNLRDCYGITILISSHILSELDLVVDRYVIMHKGKVIKSMDKAELKAQVKVQIALHTSDDQLVKNRLLELGLRVETDGQMLLIKPTLSVMELIKIVLDLPVEIFDIYHHQVSFEHYYLDLLGKDAASPLI

SEQ ID NO: 9219 - DNA, 372 bp, Streptococcus pyogenes
atgtccgccaagaaaactttttttgcaagtaatttaaagtaccttagattaaaaaagaacatggaacaattagaacttgctaatctcctaggacgaaaaagctcttcttcaatcagtgagtgggaaaaaggaaaatatactccaaagtctggtctattaagtgatattgctgctatctttgatgttagtttaaccgccctaatggaagaagatttaaccttagaaaataagggagtctcttatcagttgccacaacgagagttagcgatgatttcagaacaattatccgaaaataactacactaagtgggttgacttcgcacaaattcttttagaacaacaagctaaagaagatcgtgaattagataaccac

SEQ ID NO: 9220 - protein, 124 aa, Streptococcus pyogenes
MSAKKTFFASNLKYLRLKKNMEQLELANLLGRKSSSSISEWEKGKYTPKSGLLSDIAAIFDVSLTALMEEDLTLENKGVSYQLPQRELAMISEQLSENNYTKWVDFAQILLEQQAKEDRELDNH

SEQ ID NO: 9221 - DNA, 909 bp, Streptococcus pyogenes
atggtatctgtttcccttataatgagtgtaatatactattttaagaccatacatgataaattgagttttgttacccaaagatggttaggtgattacaaagctcgtatagaactattatttctacttcttatcctttgttggattgtactcatgaaggtattagttaaagattttttgctattttttatagttgttgacgcaagcacgttgttttgtctagtggtaatttcttgcatcttttattatttagaaaactccaaacaaaattttgactatgaaaatagaagactgaactattttatgaaatcagaggaaaacatgagagtggagttctcaaattatttgcatgatgatgttttacaaaatatcatagcgataaaaaacttgttttctctagaaaatagtaatataacacatggttttattgttaatgagttgaatgatttagtttctggtatcagagatgaaatggatacttaccacccaatagttcccgctaatcaaacaatgaaagaaaacatacagtctctttttgatgatattgttaaaagtagaaaaagtaataccttattgtattttaactgttcagataatatggtagtgccatccccatatggagatattgtttataggtttataaaagagctaataaacaatgctataaaatatggagatggaaaagacattcgtttatctttaacgattcaatctgatattattatcattgaggagagcaatcaagtagtggaaaaagtacactctataaattatggcagaggattgaaatcatttcaagaaacactagcagcttttgatggagatctagaactacaaatggatactaaacaatttactatcagaatattacttcccatagattggaaattgtgttatgaagattttattaat

SEQ ID NO: 9222 - protein, 303 aa, Streptococcus pyogenes
MVSVSLIMSVIYYFKTIHDKLSFVTQRWLGDYKARIELLFLLLILCWIVLMKVLVKDFLLFFIVVDASTLFCLVVISCIFYYLENSKQNFDYENRRLNYFMKSEENMRVEFSNYLHDDVLQNIIAIKNLFSLENSNITHGFIVNELNDLVSGIRDEMDTYHPIVPANQTMKENIQSLFDDIVKSRKSNTLLYFNCSDNMVVPSPYGDIVYRFIKELINNAIKYGDGKDIRLSLTIQSDIIIIEESNQVVEKVHSINYGRGLKSFQETLAAFDGDLELQMDTKQFTIRILLPIDWKLCYEDFIN

SEQ ID NO: 9223 - DNA, 1773 bp, Streptococcus pyogenes
gtgaaccaaggaaaaataataaccgtttcgggacctcttgttgtggcttctgggatgcaagaagctaatattcaagatatttgtcgtgtgggacatcttggcttagtcggagaaattattgaaatgcgtcgcgatcaagcgtctattcaggtttatgaggaaacatcagggatcggtccaggagaaccagtagtgactactggttgtcctttgtcggtcgagttaggcccgggcctgatttcagaaatgtttgacggtattcagcgaccgcttgatcgttttcaaaaagcaacggacagcgactttttaatccgtggtgtggctatcccaagtcttgatcgaaaggctaagtgggcatttattcccaagctaagtgttggtcaagaagtagttgcaggtgatattttaggaactgtgcaagaaacagctgtcattgagcaccgtatcatggttccttataaagtttcagggaccttggtggctattcatgcaggggacttcacagtaacagatacagtttatgaaattaagcaggaagacggttccatttaccaaggtagcctcatgcagacttggccagttcgtcaaagtcgccctgttgctcaaaagcttatcccagtcgaacctttggttacaggtcaacgggttattgacacctttttccctgttacaaaaggtggtgccgctgccgttcctggaccatttggggcaggaaaaacagttgtgcagcatcaaatagctaaatttgccaacgttgatattgttatttatgtcggttgtggggaacgcggcaacgagatgaccgacgttttgaatgagtttccagagttaattgacccaaatacaggccagtccattatggagcgcacggtgttaattgcaaacacctctaatatgccagtagcagcgcgtgaagcgtcgatttacacaggtattaccattgccgaatatttccgtgatatgggctattctgtggctatcatggcagactcgacatcacgttgggcagaagctctgcgcgagatgtcaggacgcctacaagaaatgcctggtgatgaaggctacccggcttacttagggagtcgtattgccgaatattatgaacgggctggtcgtgttcggaccttgggaagtcaagaacgtgagggaaccattacagccatcggcgcggtttctcctcctggaggggatatttcagagcctgtcactcaaaacacccttcggattgtcaaagttttctgggggctcgacgcgcctcttgcgcaacggcgtcacttcccagcgattaactggctgacgtcttattcattgtatcaagatgatgtaggaagctatattgaccgtaaacagcaatctaattggtccaacaaggtaactcgtgccatggctattttgcagcgtgaagccagtctagaagaaattgtacgcttggtggggcttgattcactgtctgaacaagatcgtttgaccatggctgttgcccggcaaattcgggaggattatctccagcaaaatgcctttgattcggtggatacctttacttcctttccgaaacaagaggccatgctaaccaatattttgacctttaatgaggaagccagcaaagccctttctttgggagcttattttaatgagattatggaaggcactgctcaggtacgcgatcgcatcgcacgcagcaaatttatcccagaagaaaacttagagcagattaaagggcttactcagaaggttaccaaagagattcaccacgttttagcaaagggaggaatt

SEQ ID NO: 9224 - protein, 591 aa, Streptococcus pyogenes
VNQGKIITVSGPLVVASGMQEANIQDICRVGHLGLVGEIIEMRRDQASIQVYEETSGIGPGEPVVTTGCPLSVELGPGLISEMFDGIQRPLDRFQKATDSDFLIRGVAIPSLDRKAKWAFIPKLSVGQEVVAGDILGTVQETAVIEHRIMVPYKVSGTLVAIHAGDFTVTDTVYEIKQEDGSIYQGSLMQTWPVRQSRPVAQKLIPVEPLVTGQRVIDTFFPVTKGGAAAVPGPFGAGKTVVQHQIAKFANVDIVIYVGCGERGNEMTDVLNEFPELIDPNTGQSIMERTVLIANTSNMPVAAREASIYTGITIAEYFRDMGYSVAIMADSTSRWAEALREMSGRLQEMPGDEGYPAYLGSRIAEYYERAGRVRTLGSQEREGTITAIGAVSPPGGDISEPVTQNTLRIVKVFWGLDAPLAQRRHFPAINWLTSYSLYQDDVGSYIDRKQQSNWSNKVTRAMAILQREASLEEIVRLVGLDSLSEQDRLTMAVARQIREDYLQQNAFDSVDTFTSFPKQEAMLTNILTFNEEASKALSLGAYFNEIMEGTAQVRDRIARSKFIPEENLEQIKGLTQKVTKEIHHVLAKGGI

SEQ ID NO: 9225 - DNA, 1413 bp, Streptococcus pyogenes
atgagcgttctcaaagaatatcggacggttagcgaagtggttggccctttgatgattgttgatcaagttgcaggagtgcactacaacgaattggtagatattactttgcataatggagaaaggcgtaaaggtcaagtcttagaagtccaaggtgacaaggctatggtacagctatttgaaggatcaactggcatcaacctagccaaaaccaaggttcgatttacagggcatcctttggaattagccgtatcagaagatatggtagggcgcatctttgatggaatggggcagcccatagacggcggtccagaacttattcccgaaaaataccttgatattgatggtcaagcgatcaatcctgtcgctcgtgattacccagacgaatttatccagacaggtatctcagctattgatcacctcaataccctcgttcgtggtcaaaagttaccagttttttcgggctcagggttacctcataatgaattggccgcacagattgctcgtcaggcaactgttctaaactctgatgataactttgcggttgtgtttgcagctatgggtattacttttgaagaggcagaattctttatgaatgacttgcgtgaaacgggtgccattgatcgatctgttttatttatcaatttagctaatgaccctgctattgaacgcattgcaacaccacgtatagctctgacaacagccgaatacttggcttatgaaaaaggtatgcatgttttagtcatcatgacagatatgacaaattattgtgaagccttacgagaagtatcagccgctcgcagagaagttccaggcagacgaggttatcctggctatctctatactaatctctccaccttatatgaacgggctggtcgcttgatcgggaaaaaagggtcagtgactcaaattcctattttaaccatgccagaagatgacattacccaccctatccccgatttgacaggttatattaccgaaggtcagattattttgtcgcaagaactatataaaaatggttttagaccgcctattaatgtcttgccatcgctatctcgcctaaaagataaaggctcaggtgaaggtaagactcgacaagaccatgctgctacaatgaatcagctctttgcagcctatgcccaaggaaaacaagctaaggaattggctgttgtgctcggtgaatcagccctttctgaaacggataaactatatgtggcctttaccaaccggtttgaagaagaatacattaaccaaggattttacaccaaccgtagcattgaagaaagtcttgacttgggttgggaattgttgtcgattttgccacgtaccgaattaaaacgcattaaagatgatatgttagatcgttatttgcctaaagcagataccacgatgacaaaggtttttgttgcaaatgat

SEQ ID NO: 9226 - protein, 471 aa, Streptococcus pyogenes
MSVLKEYRTVSEVVGPLMIVDQVAGVHYNELVDITLHNGERRKGQVLEVQGDKAMVQLFEGSTGINLAKTKVRFTGHPLELAVSEDMVGRIFDGMGQPIDGGPELIPEKYLDIDGQAINPVARDYPDEFIQTGISAIDHLNTLVRGQKLPVFSGSGLPHNELAAQIARQATVLNSDDNFAVVFAAMGITFEEAEFFMNDLRETGAIDRSVLFINLANDPAIERIATPRIALTTAEYLAYEKGMHVLVIMTDMTNYCEALREVSAARREVPGRRGYPGYLYTNLSTLYERAGRLIGKKGSVTQIPILTMPEDDITHPIPDLTGYITEGQIILSQELYKNGFRPPINVLPSLSRLKDKGSGEGKTRQDHAATMNQLFAAYAQGKQAKELAVVLGESALSETDKLYVAFTNRFEEEYINQGFYTNRSIEESLDLGWELLSILPRTELKRIKDDMLDRYLPKADTTMTKVFVAND

SEQ ID NO: 9227 - DNA, 285 bp, Streptococcus pyogenes
atgacaaaacgtaattcaaaagcctatatattatggcaaaaaattatcaaaattttaggaattattgcactaattggtacttttttcctcgctttttggctgtatagactaggtatattaaacgatagtaatgctcttaaagacttagtgcagcgctatagattatgggggccgtttgtttttattgtcgtgcagatcatacagattgtttttcctgtgattcctggaggccttacgacagttgcaggttttttaatctttggcccctgtaacaggttttattta

SEQ ID NO: 9228 - protein, 95 aa, Streptococcus pyogenes
MTKRNSKAYILWQKIIKILGIIALIGTFFLAFWLYRLGILNDSNALKDLVQRYRLWGPFVFIVVQIIQIVFPVIPGGLTTVAGFLIFGPCNRFYL

SEQ ID NO: 9229 - DNA, 309 bp, Streptococcus pyogenes
atgaaatctattatgttagtttgtaatgccggtatgtcaactagtatgttggtgactaagatgcaaaaagcagcccaagcgcgtgaccttgaagtttctatttgggcagttcctgtgagtgaagctgacaacgaaatggctgctaatagcattgacgttctcttgttaggtccacaagtcaaattcttactaaaggattttaaagataagtttgaaccagatattaaagtagatgccattaacatggctgattatggtcttatgaacggtgaaaaagtccttgaaacagccctagcaatgatggaggag

SEQ ID NO: 9230 - protein, 103 aa, Streptococcus pyogenes
MKSIMLVCNAGMSTSMLVTKMQKAAQARDLEVSIWAVPVSEADNEMAANSIDVLLLGPQVKFLLKDFKDKFEPDIKVDAINMADYGLMNGEKVLETALAMMEE

SEQ ID NO: 9231 - DNA, 975 bp, Streptococcus pyogenes
atgacaatcacagcaaataaaagacattacttagaaaaagtgagccatcaaggaatcatatcagctttagcttttgatcaacgaggtgcactgaagcaaatgatggcagcacatcaagaaggagaagcgacagttacacagatagaaacattgaaagttctcgtttctgaggaattgacgccttatgcttcatctattttattagatccagaatatgggttgctggctactaaggtaagagctaatcagacaggcttactgttagcttacgaaaaaacaggttatgatgctacaaccactagccgtttacccgattgcttagtggaatggtcggtcaaacggttgaaagcagcaggtgcagatgctattaaatttttgctctattatgatgttgatggagatgaacaaatcaatttacaaaaacaagcttatattgaacgcattggttcagaatgtacagctgaagacatccctttttttcttgaacttttgagttatgatgagagaatatcagataacaacagtgcggcatacgcaaagcttaagccacataaggttaacggtgctatgtcagtattttcggataagcgttttggcgttgatgtgctaaaagtagaggttcctgttaatatggcttatgtagaaggttttactgaaggggaagtccattacagtcaagctgaggctattaaagcttttcaagaccaagaagctgccagccacctcccttatatctatttgagtgcaggcgtatctgccaaactttttcaagagacattatactttgcagcagcagcaggtgctcaatttagtggtgttttgtgtgggcgtgccacgtgggcaggatccgttccagtttatattactaaaggagaggacgaagcaagaaagtggctatgcactgaaggcttccaaaatattgacgagttaaacagggtactcgaagagaccgctagcccttggacggaaaaaatc

SEQ ID NO: 9232 - protein, 325 aa, Streptococcus pyogenes
MTITANKRHYLEKVSHQGIISALAFDQRGALKQMMAAHQEGEATVTQIETLKVLVSEELTPYASSILLDPEYGLLATKVRANQTGLLLAYEKTGYDATTTSRLPDCLVEWSVKRLKAAGADAIKFLLYYDVDGDEQINLQKQAYIERIGSECTAEDIPFFLELLSYDERISDNNSAAYAKLKPHKVNGAMSVFSDKRFGVDVLKVEVPVNMAYVEGFTEGEVHYSQAEAIKAFQDQEAASHLPYIYLSAGVSAKLFQETLYFAAAAGAQFSGVLCGRATWAGSVPVYITKGEDEARKWLCTEGFQNIDELNRVLEETASPWTEKI

SEQ ID NO: 9233 - DNA, 246 bp, Streptococcus pyogenes
gtgttaacgatgatatggtctttaattgtaggtgcctttatcggcatgatagcaggtaaaatgactgaaaaaagccagtccatgggttgttttactaatattatcgcaggtctcatagggtcagctgttgggcaaaggctttttggggattggggaattcagttggcaggtatggctattttcccgtccattttgggagcagcaattgtaattgtacttgtttcagctatttttggaaaaaggtat

SEQ ID NO: 9234 - protein, 82 aa, Streptococcus pyogenes
VLTMIWSLIVGAFIGMIAGKMTEKSQSMGCFTNIIAGLIGSAVGQRLFGDWGIQLAGMAIFPSILGAAIVIVLVSAIFGKRY

SEQ ID NO: 9235 - DNA, 834 bp, Streptococcus pyogenes
atgagtaagaacagcagtcatattcaggtgcaaaacctttcctttgcttatgaggaaaaacttgttttagatgacctgacctttagcattccaaaagggaaaattaccactattatgggggcaaatggcagtggcaagtcaaccttattacaattattaaccaaaaaccttccgttaaaacaagggcaggtttggcttgagcaggaagaattagcaacgatttctctcaaggcttttgcgaaaaaagtggcagtggtacaccaataccatcaagtggtcgaaggtttgttagtgggtgaattggtagccatggctaggcttgcccgtcgttctttttttaaaactactaccaaagaagatgaggagcgccttgcttgggccttagaagtaacggctttgagtgattatgtttatcgtgatatccaacacctttctggtggtgaacagcagagggtttggattgccatggcccttgcccaggatacagatattatttttttagatgagccaacgacttatttggatattaagtaccagcttgacattctcaagctgattactaaaatcaaccaagagctaggcctaacgattgtgttagtattacatgacatcaatcaggccttgtctctttcagaccatcttattggactgaaagatgggcgactttatgcccaaggtcaaccaagagacctccttgatcaacagtttatcagagatgtctttggtgttgaattgccctttgttgagagaaatggtcaacagtttgtcctcacttcattggtcaatgaaaccaatggtattagaactcaaaggagagataggaacaagaacaga

SEQ ID NO: 9236 - protein, 278 aa, Streptococcus pyogenes
MSKNSSHIQVQNLSFAYEEKLVLDDLTFSIPKGKITTIMGANGSGKSTLLQLLTKNLPLKQGQVWLEQEELATISLKAFAKKVAVVHQYHQVVEGLLVGELVAMARLARRSFFKTTTKEDEERLAWALEVTALSDYVYRDIQHLSGGEQQRVWIAMALAQDTDIIFLDEPTTYLDIKYQLDILKLITKINQELGLTIVLVLHDINQALSLSDHLIGLKDGRLYAQGQPRDLLDQQFIRDVFGVELPFVERNGQQFVLTSLVNETNGIRTQRRDRNKNR

SEQ ID NO: 9237 - DNA, 363 bp, Streptococcus pyogenes
atgactgtaaaaattaatacaaaagatggtctaatcgagctatccgacgatgtgattgcaactgtcgtgggaggatcagcaacggaaatttttggtgttgttggaatggccagcaaaagtgcaataaaagacaattttcaatcactacttcgcaaagaaaactacgctaagggtgttgtagtaaaatcaacagatctgggtatttctgttgatgtctacactgtgatgagttatggtgtgaaaatcagtgaagtctctaaaaatatccaagaacgcgtgaaatttaaccttgaaagtcagcttggtctcactgctgatatggttaatgtttacgtgcaaaatattaaggttgtaggagaaaat

SEQ ID NO: 9238 - protein, 121 aa, Streptococcus pyogenes
MTVKINTKDGLIELSDDVIATVVGGSATEIFGVVGMASKSAIKDNFQSLLRKENYAKGVVVKSTDLGISVDVYTVMSYGVKISEVSKNIQERVKFNLESQLGLTADMVNVYVQNIKVVGEN

SEQ ID NO: 9239 - DNA, 480 bp, Streptococcus pyogenes
atgcctcagattacccttgtttttattagcctcagtggcaacacccttagctttgtcaagcggctatccctttatctagcagacaattacgattaccatgtcaaacagattaacattaaagatttgaagcacgagacttttcccgtcaaggaagagtttgtggcgattttacccacttatctagaaggcggaaatggcgttgactctggtgatgtggagatcctcaccactcctttgggagagtttattgctgcccatggcaacgcccagcgttgtcttgggattattggctcaggcaacaaaaactttaaccatcagtattgcctgacagccaaacagtatgccaaacgctttggctttccactgctaggtgattttgagctgcgagggactcctgatgacatttcgcggttagcccaggtcatcatggaggccagctccagacactcgtctaacgacacacagacactgcctaacagc

SEQ ID NO: 9240 - protein, 160 aa, Streptococcus pyogenes
MPQITLVFISLSGNTLSFVKRLSLYLADNYDYHVKQINIKDLKHETFPVKEEFVAILPTYLEGGNGVDSGDVEILTTPLGEFIAAHGNAQRCLGIIGSGNKNFNHQYCLTAKQYAKRFGFPLLGDFELRGTPDDISRLAQVIMEASSRHSSNDTQTLPNS

SEQ ID NO: 9241 - DNA, 840 bp, Streptococcus pyogenes
atggaaattggtgaaaccgttgaattcattaggcattcaaaaaacatttcgattaaacaagtttgtggtgattatctcactaggcaaacctattatcgttttattaaaaataatcttgacatttcttcgaaaaagttactttatatcttagacaacttgaatgtcaatgttgatgagtttctctttattagtaataactttaaacaatacaaagaatttattgatatggatacggcaaaacattattttgaatgccgaaacatagaaggtttaaatcatatccttgattcttataaagatagtaagtcaacaaaggaaaagaacctttttgccttggtcaaggtgttattagcaactcttactgaggaagactgtctgacagagcggacttatttgtcaaactatcttattaatattgaaacttggagtcactatgagactgtgctttttaataattgtatgtttatttttgagtcttgctttattgagatggtgttttcaaaagttattttgaacctcgataaatacaataccctaaggtattatgggaatgaatcgattcggatgtttgtcaatatgttgattttgtttattcagcgacaagagtatgataaagcttctgagattttggcaaaaattgaagattatcagctaaatgatgattgcttatatgaacggtgttgtgtgtctttttttgatggcattattggcctcataaatggtaaagagggggctgagcaaaagtgtgtgcagatcttggagatcttccaattacttaattgcaaaacgatccatcatatgtttcaaacctacctagaagccattaaacataaactgtcc

SEQ ID NO: 9242 - protein, 280 aa, Streptococcus pyogenes
MEIGETVEFIRHSKNISIKQVCGDYLTRQTYYRFIKNNLDISSKKLLYILDNLNVNVDEFLFISNNFKQYKEFIDMDTAKHYFECRNIEGLNHILDSYKDSKSTKEKNLFALVKVLLATLTEEDCLTERTYLSNYLINIETWSHYETVLFNNCMFIFESCFIEMVFSKVILNLDKYNTLRYYGNESIRMFVNMLILFIQRQEYDKASEILAKIEDYQLNDDCLYERCCVSFFDGIIGLINGKEGAEQKCVQILEIFQLLNCKTIHHMFQTYLEAIKHKLS

SEQ ID NO: 9243 - DNA, 396 bp, Streptococcus pyogenes
ttgctatctgcttcttatttaagagtgattgttgctccagcttcttcaagtttagctttgatttcttcagcttctgcagcagcaacgccttctttaacgttagcaggtgctccatcaacaagacctttagcttctttaagaccaagacctgtgatttcacgaacagctttgataacgccaacttttttgtcgccagcagatgtcaattcaacgtcgaatgaatctttagcagcttcttcagcaccaccagcagctgcagcagctacaggagcagctgcagttacaccaaattcttcttcgatagcttttacaagatcgttaagctcaaggattgaagcttctttaatttcagcaataatgttttcaatgttcaatgccattgtgatttcctccaaa

SEQ ID NO: 9244 - protein, 132 aa, Streptococcus pyogenes
LLSASYLRVIVAPASSSLALISSASAAATPSLTLAGAPSTRPLASLRPRPVISRTALITPTFLSPADVNSTSNESLAASSAPPAAAAATGAAAVTPNSSSIAFTRSLSSRIEASLISAIMFSMFNAIVISSK

SEQ ID NO: 9245 - DNA, 513 bp, Streptococcus pyogenes
atgaaaattgctgtaggttgtgaccatattgttacttatgaaaaaatcgctgttgtggattacctaaaatcacaaggtcataaagttattgattgtggtacgtatgataatgttcgcacacactatccaatttttggtaaaaaagttggtgaagcagtagcaagtggtgaagcagaactaggtgttgttatctgtggtactggtgttggtatcacaaatgctgtaaacaaagttcctggaattcgttcagcactcgttagagatatgacatctgctatctactcaaaagaagagctaaacgcaaacgttattggttttggtggaaaaattatcggtggtttattgatgaatgatattatcgatgctttcttggccgcggaatacaaaccaactgaagaaaataaaaaatggattgaaaaaatggatagcttgcaacatgctagccaagatcaaaacaacccacacttctttgatgaattcctagaaaaatgggaccgtggtgaatatcacgac

SEQ ID NO: 9246 - protein, 171 aa, Streptococcus pyogenes
MKIAVGCDHIVTYEKIAVVDYLKSQGHKVIDCGTYDNVRTHYPIFGKKVGEAVASGEAELGVVICGTGVGITNAVNKVPGIRSALVRDMTSAIYSKEELNANVIGFGGKIIGGLLMNDIIDAFLAAEYKPTEENKKWIEKMDSLQHASQDQNNPHFFDEFLEKWDRGEYHD

SEQ ID NO: 9247 - DNA, 771 bp, Streptococcus pyogenes
atgaaaaagaaagagcgtcatgaaaaaattctcgatatcttaaaagttgacggttttataaaagtaaaagatattatcgatgaaatgaacatctcagatatgaccgctagacgagatctcgatacattggcagataaaggattacttatcaggacccatggtggtgctcaatatttggattattcttcagcaaaggacgaaggtcacgagaaaacacacactgaaaagaaggtcttacagactaccgaaaaaaaacaaattgcacaaagagctaaaaacattattaaagatggcgaaactgtctttataggtccagggacaacattagagcatctagctgtcgaattgaaaaatagaaatatcagagttattacaaatagccttcctgtttttttaattttgcacccgagcactactattgatttgattttaattggtggtgaatgtcgtgaaattactggtgcttttgttggtgctattgccattaataacctagaaacattaacattttcaaaagcttttgtcagcgcaaacgcagtttacaataattctattgcgacgtacagtgatctcgaaggagaagttcaaagggttgcattgaataatgctgttgagaaaatccttctagttgatagtaccaagtttgaaagttatgacttctataatttttaccaactagatcaagtggacttaattgtgactgataaaaatgtgacaactgatatcatagaaaagtacaagaaattctcaaaaatcataatcgctgacaag

SEQ ID NO: 9248 - protein, 257 aa, Streptococcus pyogenes
MKKKERHEKILDILKVDGFIKVKDIIDEMNISDMTARRDLDTLADKGLLIRTHGGAQYLDYSSAKDEGHEKTHTEKKVLQTTEKKQIAQRAKNIIKDGETVFIGPGTTLEHLAVELKNRNIRVITNSLPVFLILHPSTTIDLILIGGECREITGAFVGAIAINNLETLTFSKAFVSANAVYNNSIATYSDLEGEVQRVALNNAVEKILLVDSTKFESYDFYNFYQLDQVDLIVTDKNVTTDIIEKYKKFSKIIIADK

SEQ ID NO: 9249 - DNA, 555 bp, Streptococcus pyogenes
atgtcgcatttttctgataagtttatggagatttcaggaaaaattgggtcacaacggcatttagtagctattcgtgattcctttatttcaatgatgcctattaccatggcaggttcagttgctgtcttattgaacgtttttttacgcgatattccaaacaatatgggatggacaggatttgcaaaagctatgcaacctgttatcgacatcaatggctatgtttattttgggacaattggtatcatggcgctcttttttgcctttgctttcggttacaatttagctgttatgcataagattaatccattggcaggaggattgatttcttttggctcatttattgccaccctacctcagactttaaccatttcgacaccacttgaaaatgcctctgctaacctaattagcaatttgaaagaaatggggctttcagtcgttactgcgggtggagcttcaagtattgaaactagtcaatggggagcaatagctctaaagtatgtcggtgccacaggcttgttcacagctttaattattggctttttatcaagttttgtg

SEQ ID NO: 9250 - protein, 185 aa, Streptococcus pyogenes
MSHFSDKFMEISGKIGSQRHLVAIRDSFISMMPITMAGSVAVLLNVFLRDIPNNMGWTGFAKAMQPVIDINGYVYFGTIGIMALFFAFAFGYNLAVMHKINPLAGGLISFGSFIATLPQTLTISTPLENASANLISNLKEMGLSVVTAGGASSIETSQWGAIALKYVGATGLFTALIIGFLSSFV

SEQ ID NO: 9251 - DNA, 948 bp, Streptococcus pyogenes
atgataagacaaaccaacaaaaagacatccttttggaaaaatgtgattaaataccgggccttattattaatggtattaccaggtttcatctggttcatctttttcttttatattccagttttagccaatgtggttgcttttaaagattttcattattcagcagggggctttatggaaagtttgaaggagagcccttgggttggtttggctaacttcaaatacctctttgcttccaaagatgcttggttgattaccagaaataccattgcttacaatgtgattttcttactctttaatgttttctttgcgattgcttttgccattatcatgagtgagttacgaaataagagaacggttaaggtctatcacaccatgtccttattgccttatttcttatcatgggtggttattgaatactttgtttctgcctttttaaatacggataaaggtttcattaatcagctcttgaccggaagtggagcagatccaatcaagtggtattccaatcccacttggtggcccttgattttacttttcatgagtgtctggaaggggctaggctacaatagcattatctactatgcttcagtcaaagggatttctgatacttattatgaagctgctatggtggatggtgcaagcaaatggcaacaaattaggaacatcaccattccacaattattgccaatgatgtctatcttattgatcattaatattggtaatatttttaaatctgatttcggacttttctacgttattcctaagaattcaggcccactttatgacgtgaccagtgtgttaaatacctatgtctacaatgccttgactgctacaggagatattgggatggcatcggcagctagcctttatcagtcagtagttgggaccagcatcttgttagtcaccaatgcgattgttcgtcgcatggaccctgatgcagccttgttt

SEQ ID NO: 9252 - protein, 316 aa, Streptococcus pyogenes
MIRQTNKKTSFWKNVIKYRALLLMVLPGFIWFIFFFYIPVLANVVAFKDFHYSAGGFMESLKESPWVGLANFKYLFASKDAWLITRNTIAYNVIFLLFNVFFAIAFAIIMSELRNKRTVKVYHTMSLLPYFLSWVVIEYFVSAFLNTDKGFINQLLTGSGADPIKWYSNPTWWPLILLFMSVWKGLGYNSIIYYASVKGISDTYYEAAMVDGASKWQQIRNITIPQLLPMMSILLIINIGNIFKSDFGLFYVIPKNSGPLYDVTSVLNTYVYNALTATGDIGMASAASLYQSVVGTSILLVTNAIVRRMDPDAALF

SEQ ID NO: 9253 - DNA, 555 bp, Streptococcus pyogenes
atgtcatctcaaaaattagctaattatattgaattgagtatgtatgccgctttaatttttatttcagtacaagtgttgcgtgtccctgtcggtatgcagtttattcatcttggcaatgcattagttgttattgcagtcttaatctatggtagtaaaaaaggagctctagttgctagtcttggtttagggatctttgatgttttgaacggctatgcttcagtcgtttggataactatcttagaatccttggctatttgtttaattttgcatttggtatatgaaagagctatgcaatctagtaaaaaaccaaaagccattataacaataacagttattgctgcattgtcaaaattaactattaaccttataaaatacttactgttagcttatataggtactcagctaccactttcggtatctttttgggtagctcttggaaaaattggtggtagtttcggaacatcttttgtgactttagttgctgttcctcttttgtatcctgttatcaaaaacttaaaagaaaaggttacaatcggacaagcaaaaagaggtttt

SEQ ID NO: 9254 - protein, 185 aa, Streptococcus pyogenes
MSSQKLANYIELSMYAALIFISVQVLRVPVGMQFIHLGNALVVIAVLIYGSKKGALVASLGLGIFDVLNGYASVVWITILESLAICLILHLVYERAMQSSKKPKAIITITVIAALSKLTINLIKYLLLAYIGTQLPLSVSFWVALGKIGGSFGTSFVTLVAVPLLYPVIKNLKEKVTIGQAKRGF

SEQ ID NO: 9255 - DNA, 858 bp, Streptococcus pyogenes
atgagaaagacctatgtttcaatatccatgaaacgcaaacgtttcttcacccaattattgacttatctctatctaatctccttagtgatcgtgattttattcccaatactagtgacggtcagttcagcttttagaccaggaaataccacagcctttagttttcattttgatgggccatggaccttgtctaactttaaaacactctttcaagataccttatacttaagatggtattggaataccttgatcgtggcattcttcaccatgctcatacaagtaacagtcatcactttgacaggttatgcgtatagccgttacaatttctttggacgcaaaaaaagtttaatctttttcctagtcgtacagatggttcctaccatggcggctttaacggcttactttgttatggcgtggctctttaatgccttaaaccaatactggttcttgattttgatttacgtcggtggtggtattcctatgaatgcctggttgatgaagggttattttgacacggtaccttatgacttggacgaatctgctaagttagatggttctggacactttaggaccttctaccaaattgtccttcctcttgtgcgaccaatgattgcagtacaatccttatgggcttttatgggtcctttcggagacttcatgttggctaaattccttttaagggcgcaagaaaattatacggtagcagttggtcttcaatcgtttattacgaatgatgctagaaatcccaaggtaaccttatttgctgcgggagctattctgattgcagtgcctatttcagttctctttttcttcctacagaaaaatttcgtttccggtttaacaagtggtggtaccaaaggg

SEQ ID NO: 9256 - protein, 286 aa, Streptococcus pyogenes
MRKTYVSISMKRKRFFTQLLTYLYLISLVIVILFPILVTVSSAFRPGNTTAFSFHFDGPWTLSNFKTLFQDTLYLRWYWNTLIVAFFTMLIQVTVITLTGYAYSRYNFFGRKKSLIFFLVVQMVPTMAALTAYFVMAWLFNALNQYWFLILIYVGGGIPMNAWLMKGYFDTVPYDLDESAKLDGSGHFRTFYQIVLPLVRPMIAVQSLWAFMGPFGDFMLAKFLLRAQENYTVAVGLQSFITNDARNPKVTLFAAGAILIAVPISVLFFFLQKNFVSGLTSGGTKG

SEQ ID NO: 9257 - DNA, 1305 bp, Streptococcus pyogenes
atggtagagaaccaaagacaacagaagcctaataaagccatgtggctatctgttatcccaggtttgggacaactatacaataaacaaatcgttaaagggggagtcttattagttgttttcttcctagagctactagaaattgtagttctaggaattcctgctttaacaggtctttacagtcttggaagtgttccaatgcaagatcactccttatttatgttaattaagggggccatgcaattaattactctagtcttatttggtatttttcatttggttgctatgagagatgctaaattagttgcacatcaaatgaatgaaggcaagaaggttccggtgacggctaaagagacccttgaagcgatttatgaaaaaggatttccttacttgctcatcattccggcttatttagcaatggctttcgctattatttttccagttttagtgaccttgctgattgcttttaccaattacgattttaggcatattcctccgtatcgtttattggattgggtagggttgaagaattttcttaatatcttagaattaagcaccttcaaaacagcatttacatctgttttgtcatggacgctgatctggacattagcagcgacaagtcttcaaattgttattggaattgcaacggctgttattgctaatcaatcctttatcagaggaaaacgtctctttggtgtgatattcttgttaccatgggctgttccagcatttatctctattatgagttttggtaatttctttaatgattccattggggccatgaatgttcaggttcttcctttcatcgagaaattccttcctttcgttgacttcggaattgtgtcctggaagacagaccccttctggacaaaagtggctgttattatggtgcaaggttggctaggatttccctatatctatattttggtatcaggtattttacaggcaattccagctgatttatacgaagcagcaaccgttgatggtgcgacagtcttacagaaattccgccatatcaccatgccaatgatttttgcggttgcagcaccaacctttatctctcagtacacctttaacttcaataatttctctattatttatctgtttaataatgggggccctggtactgtggggggcggagctgggacaactgatattctgatttcttggatttacaagttgaccacacaaacctcgcctcagttttcgatggcgtcggcagtgaccttaatcatctctgtaatagtgatttcggtatcgttgattacctttaagaaatttaaagcttttgatatggaggagagatca

SEQ ID NO: 9258 - protein, 435 aa, Streptococcus pyogenes
MVENQRQQKPNKAMWLSVIPGLGQLYNKQIVKGGVLLVVFFLELLEIVVLGIPALTGLYSLGSVPMQDHSLFMLIKGAMQLITLVLFGIFHLVAMRDAKLVAHQMNEGKKVPVTAKETLEAIYEKGFPYLLIIPAYLAMAFAIIFPVLVTLLIAFTNYDFRHIPPYRLLDWVGLKNFLNILELSTFKTAFTSVLSWTLIWTLAATSLQIVIGIATAVIANQSFIRGKRLFGVIFLLPWAVPAFISIMSFGNFFNDSIGAMNVQVLPFIEKFLPFVDFGIVSWKTDPFWTKVAVIMVQGWLGFPYIYILVSGILQAIPADLYEAATVDGATVLQKFRHITMPMIFAVAAPTFISQYTFNFNNFSIIYLFNNGGPGTVGGGAGTTDILISWIYKLTTQTSPQFSMASAVTLIISVIVISVSLITFKKFKAFDMEERS

SEQ ID NO: 9259 - DNA, 921 bp, Streptococcus pyogenes
atgagacatgatcgtctattctactataataaaggagaacacctcatgagcttgttatgtattgatataggaggcacttcccttaaatttgccctctgtcacaatggccaattaagccagcaaagcagctttcccactccctctagtctggaaaagttttaccaattactcgaccaagaagttgctcgttactctgcttaccatttctcaggtattgccatcagttcacctggggcagtcaataaagaaaagggggttatcgaaggcgccagcgctattccctacattcaccattttaaaatacaagaggccttagaagaacggctacattaccctatttctatcgaaaatgatgccaattgtgccgccttagctgaagctaccttaggggcaggaaaaggcgctagtagcctagccatgctcgttcttggtactggagttggaggaagcttggtcattgatggcaagatttaccatggtgcccacttatttgggggcgagtttggtttcatgatcatgaacgaccgctaccaaacctttagtcagttagggacagtggtaaatatggccaagcgctatagtgcaatcgtcaataacggaaaagattatactggcaaagctgtccttgccctcgcagaacaaggagatcccctagcactcaaagaaaggcaggtctttctccaaagtttagccatcggtatttttaacattcaacacgcctttgatcctcaactgattttaatcgggggtggtgtttcccaagctgactttctactgtcagcgattgaagctgaactagacaaactctaccaagccgtcgaaatctccgaccttagaccccaattagctatttgtcactttaaaaacgaagctaatcttctgggagctgccattgatttttaccaagaacacaaggaggcc

SEQ ID NO: 9260 - protein, 307 aa, Streptococcus pyogenes
MRHDRLFYYNKGEHLMSLLCIDIGGTSLKFALCHNGQLSQQSSFPTPSSLEKFYQLLDQEVARYSAYHFSGIAISSPGAVNKEKGVIEGASAIPYIHHFKIQEALEERLHYPISIENDANCAALAEATLGAGKGASSLAMLVLGTGVGGSLVIDGKIYHGAHLFGGEFGFMIMNDRYQTFSQLGTVVNMAKRYSAIVNNGKDYTGKAVLALAEQGDPLALKERQVFLQSLAIGIFNIQHAFDPQLILIGGGVSQADFLLSAIEAELDKLYQAVEISDLRPQLAICHFKNEANLLGAAIDFYQEHKEA

SEQ ID NO: 9261 - DNA, 813 bp, Streptococcus pyogenes
ttgaccaaacgtaatattaccattaccttaccagataatgtaccacctgcggttaataaagcctttgctgccattattccaggaacagttgcgatttacgcttcggcaattttcgcctacctcattttcgcattaacaggttcttccctaagtgatgtcatttcaacctatatccaattaccattgctaggcttatcacagggtattggttcagttatcttgttaaccttcttagttcaactgctctggttcttcggcttgcatggtcataatgtcttagccccagtgatggatggtatttatatggtagctttaacagaaaatacagctgcttacaatacagcgcatagcgctgctaatttaccatacctttggacacgcgggtcctttgatgcttatgctcaaatgggtggttcaggagtaaccttggcattgattattgctatcttcatattctcaaaacgagaagagcataaaaccattgccaaattgtccgcaccaatgggtgttttcaatatcaacgaaccaattacatttgggatgccaattgttttgaatccaacctttgtgattccatggctaattgtgccaccaatttgtgctagcatagcttattttgctactgcaataggtttgattccaccggtattcttatcagtaccttggattacccctgttggactttatgcttacctagctactggaggtaatattatggcaggtttggtttcactgtttaacctctttgttgccttccttatctgggcaccatttgtcattttggccaataaagaaaaagcgagtgaccttgca

SEQ ID NO: 9262 - protein, 271 aa, Streptococcus pyogenes
LTKRNITITLPDNVPPAVNKAFAAIIPGTVAIYASAIFAYLIFALTGSSLSDVISTYIQLPLLGLSQGIGSVILLTFLVQLLWFFGLHGHNVLAPVMDGIYMVALTENTAAYNTAHSAANLPYLWTRGSFDAYAQMGGSGVTLALIIAIFIFSKREEHKTIAKLSAPMGVFNINEPITFGMPIVLNPTFVIPWLIVPPICASIAYFATAIGLIPPVFLSVPWITPVGLYAYLATGGNIMAGLVSLFNLFVAFLIWAPFVILANKEKASDLA

SEQ ID NO: 9263 - DNA, 1860 bp, Streptococcus pyogenes
atgacaatcagacaatggatggcagaccatcttcatttgatggagactttagcgtgtttggtattaataataattggcctagcctttttacactcatttccacaagtggcttccgctattttcattacagccttcttgattggaggatatgcgtctgcaaaaacgggtatattggatttggtgaagaacaaacacttgtcagtggatattttgatgattttggcagctatcggtgctggaattatcggctattggctggagggtgctctgcttatttttatcttttcgttgtccaatacgcttgaagaaatggccatggaaaaaagtaaggatgctatttcagccttgatgtccttgacgccagatacagctcgtcaataccaagaagatggccatattttagaagttgagaccagatccttgagtgttggtgaccgtttacaagttcgtaaaggcgaagctgttccaattgacgggcagttgcttagtccttttggtcaatttgatgaatctatggtcactggtgagcctatcactgttgataaggcagaaggccaggatctgattgggggaaccattaaccaaggacaaaccatagatatgttggttactattgaaaatgacgatactctctttgccaagattattaatctggtggaatctgcccaagaaaagaaaagcaaaaccgccacctttatcgaaagcttagaagatggttatgtcaaatttgtgctcgtccttattcctgcctttatcctctttagccactttgtgctttcttggacttggttggctgctttttaccgagggatgattctcttaacagtagcttcaccatgtgccctaattgccagttccacacctgctagcttggctgctatttctcgtgcagccagaaagggattgattatcaaaggaggggatattgtcgataacatgggagatattaaggctgttgtcatggataaaacgggaacgctcacccaaggaaaaccttctgttgtgaatgctcattatttggaagatgagttgctcgtgaatagactggtaaaaggagcagagactgctagtacccatcctatttctaaagcccttcttgaatacactgaaaaattggagccactgacctttgaccacttagaagaaatttctgggaaaggttttcagggcttctatcaagggcaagaatggcgaattggcaagaaaacctacattttggaaaaggttcaagacctatcagcttttgaagaaactattcaagtggaagaaaatcaagggaaaaccctaatctttgtttcacgtgaccatcaattgatagcttactatgccctcttggatgatatcaaaatagaatcaaaacgtgctattaagtctcttcatgccatgggaatcaaaacagtcatgttaacaggtgaccaagaacgaaccgccaattatgtggcacaaaaacttggtattgatgaagtggtagccaactgtatgcctcaagataaggtggctaagttagcagaattaaagactaaatatggttttgtggctatggtaggagatggtattaatgatgctcctgcccttgctcaagcagatgtttcttatgctattggatcaggaacagatattgcaatggaaagtgcagacagtgtgattatggatgacttgactcgtattccattttcgattcaactttcccgcacaatgaagaccattatcaaacaaaatattgtttttgccttatctgtgattaccttattgattttagccaatgtttttcaggtagttaacttgccgcttggtgttgttggacacgaaggctcaacgattttagtgattttaaatggcttgcgtttactttcttttaaa

SEQ ID NO: 9264 - protein, 620 aa, Streptococcus pyogenes
MTIRQWMADHLHLMETLACLVLIIIGLAFLHSFPQVASAIFITAFLIGGYASAKTGILDLVKNKHLSVDILMILAAIGAGIIGYWLEGALLIFIFSLSNTLEEMAMEKSKDAISALMSLTPDTARQYQEDGHILEVETRSLSVGDRLQVRKGEAVPIDGQLLSPFGQFDESMVTGEPITVDKAEGQDLIGGTINQGQTIDMLVTIENDDTLFAKIINLVESAQEKKSKTATFIESLEDGYVKFVLVLIPAFILFSHFVLSWTWLAAFYRGMILLTVASPCALIASSTPASLAAISRAARKGLIIKGGDIVDNMGDIKAVVMDKTGTLTQGKPSVVNAHYLEDELLVNRLVKGAETASTHPISKALLEYTEKLEPLTFDHLEEISGKGFQGFYQGQEWRIGKKTYILEKVQDLSAFEETIQVEENQGKTLIFVSRDHQLIAYYALLDDIKIESKRAIKSLHAMGIKTVMLTGDQERTANYVAQKLGIDEVVANCMPQDKVAKLAELKTKYGFVAMVGDGINDAPALAQADVSYAIGSGTDIAMESADSVIMDDLTRIPFSIQLSRTMKTIIKQNIVFALSVITLLILANVFQVVNLPLGVVGHEGSTILVILNGLRLLSFK

SEQ ID NO: 9265 - DNA, 603 bp, Streptococcus pyogenes
atgaatggcattgaaaaaacctgctttttaatttggaaaatgatccaattgaccctcatttttcatctcttgtccttagctggactgattgtgtttggggtggggccagcctggcaaaccattgtcaccctatttttaaaaacacctcaagaagaaaaccactattctttgaaaagggctgttcaactttggaaatcttatttcaaagaagctaatctaagatttggtctttttgccctgactttcctttttttaacctttaatttgcattgggcagtacagtttccatccttgttttggtttaccgtgtctttcttgattgtaatagccatggtttggctaaccatgacctatctttacatggttttttatgcagtgagctatgagattaacctttggaataatatgaaattagcctttatcagcgtctttttaagtttcaaatcctttttactcatgctgagtgttttgttgggaattaccttagtgacttggcaatacaaaggtctttatctctttttaaccttcggagctctagtcttttgcttggactttgtcactaaggctaatcgtcgactagtagatggagtgattgatgagtgt

SEQ ID NO: 9266 - protein, 201 aa, Streptococcus pyogenes
MNGIEKTCFLIWKMIQLTLIFHLLSLAGLIVFGVGPAWQTIVTLFLKTPQEENHYSLKRAVQLWKSYFKEANLRFGLFALTFLFLTFNLHWAVQFPSLFWFTVSFLIVIAMVWLTMTYLYMVFYAVSYEINLWNNMKLAFISVFLSFKSFLLMLSVLLGITLVTWQYKGLYLFLTFGALVFCLDFVTKANRRLVDGVIDEC

SEQ ID NO: 9267 - DNA, 924 bp, Streptococcus pyogenes
atggagaaaaagaaaaaagtcgaaaaggttaatgttagaacctttgatcgaaaaaccaatgctatctttaatattctgattggtctgtttgccatctcttgtatcattccttttatcttcgtgattattatttccttcactgatgaaagttacttgattaatcatgggtatagtttttttccagatgtctggtcaactaaggcttaccagtatatttttcaaggagccatgtcccatagaatcatgaggtcatttgggatatccgtgtttattacagtggtgggaacctttattaacacgaccatgacatcaacctatgcttatgcgatttcaagaccttatttcccatacagacgtttttttactgtttatgcacttatcaccatgctctttgcaccagggatggttgctaattacttggtggtcagcaatctccttcatttgaaggatacggtttgggccttgattttaccaatggctctgggcccatttggcatcttggtcatgagaacgttctttaaaaagacagttccagatagcattattgagtcggctcgtatggatggggctagtgaatggatgatttttatgaaaattgtcttaccattagctgttccagggattgccaccatcagtttattttctgccttaacttattggaatgattggtttaacgccttgctttatgtgcaaagtgagaatctttacccaatgcagtacttactgatgaaaattcagagcaacctacaggccttggcacaaaatgctggcatgagtgcacaaatggcagatagcttagcatcgctgccaaaagaatcagttcgtatggctatcgtggttattgcaaccttgccgattgccttgacttacccattcttccaaaagtactttgtcggtggtttgaccattggtggggtgaaggaa

SEQ ID NO: 9268 - protein, 308 aa, Streptococcus pyogenes
MEKKKKVEKVNVRTFDRKTNAIFNILIGLFAISCIIPFIFVIIISFTDESYLINHGYSFFPDVWSTKAYQYIFQGAMSHRIMRSFGISVFITVVGTFINTTMTSTYAYAISRPYFPYRRFFTVYALITMLFAPGMVANYLVVSNLLHLKDTVWALILPMALGPFGILVMRTFFKKTVPDSIIESARMDGASEWMIFMKIVLPLAVPGIATISLFSALTYWNDWFNALLYVQSENLYPMQYLLMKIQSNLQALAQNAGMSAQMADSLASLPKESVRMAIVVIATLPIALTYPFFQKYFVGGLTIGGVKE

SEQ ID NO: 9269 - DNA, 1668 bp, Streptococcus pyogenes
atggctaaacctaacagatctaccttaagcctggtttggcgtttattaaccctaatgaaaactctgctaccttggattatcttggctgttggctttgctgttatgggttttgtcatcacggtaagtattccaactggaatagcttatttaggactactagctattagacaagaagtgattccaatattagctttatatcttttgattgctctagcctttttaagaggttttgttcgttatggagagcattattttggtcattttgttgcttttcatagtttagcagcttttaggaacttgatctttaagaaactaagagctctttctccagcttgcttggatagtcaagacagtggttatttgcttaaaatgattggagaagatattgaggcattagaagttttttttgcccacacaatcgcacctatttgtacagcaatattgtctgcaggtttaatgttctggtacttttgtcaaagtagttggcagttagccttattagctttggcaacctatgcttgtttagccattgttatacccatttattttgctaatattttacaggttttactaaaaagccaaaatgaaggtcgaaaagattacctgtcttattttttagagagtttacgatcagtcaaagatcttttgcaatttcaggtattagacgagcaatttgaacgattaataaaaaaaagtaatcatgtaaatgctcttgatcgtaacgtagcgcaagcccaatttttgcaaatggcattgacttttttctggcttggcttaatgatcttagcattttcttatatggtttttgatgggatatgccatgacagcttatcatttgataaaggcttattaacttttattgctttcactgcttcgttttctccttttttagaactaggacgtttgccattaggttttaagcgtgctatgaatgcggctcgaaatatttttgaccttctagacgaaaatgtcatagtagatgaaggcacaaaacaaatagatcgtttaaggagtgtttcttttgaggacctcagttttgcttatccaaagcgccaagagctggtttttaaggatttaacagttacctttcaagaaaaggggattattggcattaaaggcgaatcaggatctggtaaatcaactttggtgaaattaattatgaaatggtataattggaagacaggagatatttttcttaatgataggaatagttgcttactaaatgctgctaaattacaagatactattgcttatgtgccacaaacagcgcagcttttccaacagtctatccgtgaaaatcttatctttggccgtcaagatatttcagatgagtccatttggaatttagctgaggcttgtggtatgaaagacagactgttagcttgtaaggaaggtttggatacgattatcaagagtccttctgacttttcagctggagaaggtcaacgtttagagttgatgcgagctttattgaaagatgcgagttgctatatttttgatgaacccacgtcaaatttagattctctaaatgaagctatcttgcttgatttaattaaaacacattgtcaaggattggtcttcttaatttctcacaggccatcaaccctagcttgtgttgatcatctattttgcgtaaaaaatggttccctaaaagaggtgaataaaaaa

SEQ ID NO: 9270 - protein, 556 aa, Streptococcus pyogenes
MAKPNRSTLSLVWRLLTLMKTLLPWIILAVGFAVMGFVITVSIPTGIAYLGLLAIRQEVIPILALYLLIALAFLRGFVRYGEHYFGHFVAFHSLAAFRNLIFKKLRALSPACLDSQDSGYLLKMIGEDIEALEVFFAHTIAPICTAILSAGLMFWYFCQSSWQLALLALATYACLAIVIPIYFANILQVLLKSQNEGRKDYLSYFLESLRSVKDLLQFQVLDEQFERLIKKSNHVNALDRNVAQAQFLQMALTFFWLGLMILAFSYMVFDGICHDSLSFDKGLLTFIAFTASFSPFLELGRLPLGFKRAMNAARNIFDLLDENVIVDEGTKQIDRLRSVSFEDLSFAYPKRQELVFKDLTVTFQEKGIIGIKGESGSGKSTLVKLIMKWYNWKTGDIFLNDRNSCLLNAAKLQDTIAYVPQTAQLFQQSIRENLIFGRQDISDESIWNLAEACGMKDRLLACKEGLDTIIKSPSDFSAGEGQRLELMRALLKDASCYIFDEPTSNLDSLNEAILLDLIKTHCQGLVFLISHRPSTLACVDHLFCVKNGSLKEVNKK

SEQ ID NO: 9271 - DNA, 1695 bp, Streptococcus pyogenes
atgaatggattaattgctcagattgagaaagggaaacctttcttcgagaaaatttctcgaaacatctatcttcgcgctattcgtgatggttttatcgctggtatgcctgttatcttgttttcaagtatctttatcttgattgcctatgttccaaatgcatggggcttccattggagtaaggatattgagaatctcttgatgacgccatacaactactcaatgggtattttaggtttgtttgtggctggtacgactgcaaaagcattaaccgattcaatgaaccgctcattgcctagcactaaccaaatcaactttatttcaaccatgcttgctgctattgtaggttttttacttatggcagcaaatccagcaaaagacggtggtttcttaactggatttatgggaacaaaaggtttgttaacggccttcatcgcagcttttattaccgtaaatgtctataaagcctgtgtgaaaaacaatgttactattcgcatgccagaagaggtgccaccaaatatatctcaagtttttaaagatttgattccatttacattatcagttgtacttctttatgtgattgaattgattgttcatactactttaggcgttaacgttgccgagtcaattggtaaacttcttgcaccattgttccaagcagcagatggttatgttggaatcactattatcttcggtgcatttgctttcttctggtttgttggtattcatggaccatctattgttgaaccagccattgcagcgattacttacgcaaatgctgaaaccaaccttcaattacttcaagctggtgaacatgctgacaagattttgacttcagggactcaaatgttcatcgttaccatgggtggtactggtgcaactctcgtcgttccattcatgttcatgtggttaacaaaatcaaaacgtaacaaagccattggacgtgcatcagttgttccaacattctttggtgttaacgaacccattttgtttggtgctccacttgttttgaacccaattttctttattccatttatcttggcaccgattgtcaacgtatggattttcaaattcttcattgacacacttggaatgaacagtttcactgcaaacttaccttggactacaccagctccattaggtctcattcttggtacaaacttccaagttctagcattcattttggcagctttgttaattgtcgttgatgtgatcatctactacccattcttgaaagtatatgatgagcaaattcttgctgaagaagcagcaggtacgaattcatcagatgccctcaaagaaaaagtagcagcaaactttgatactaaaaaagctgatgctattcttgaaaaatcagcagctaaagaaaccaaagaaatcactgatcaaactaatgttctcgttctttgtgccggtggtggtacaagtggtttgcttgcaaatgctttgaataaagcagctaaagaatatggtgcacctgtcactgcagcagcaggaagttatggtgctcaccgtgagattttaccacaatatcaacttgttatccttgcacctcaagtagcttctaactatgaagatatgaaagtggaaactgataaacttgatattaaattagctaaaacagaaggggctcaatacatcaaattgacccgtgatggtcaaggagctcttgattttgtaaaagcacagtttgaaaat

SEQ ID NO: 9272 - protein, 565 aa, Streptococcus pyogenes
MNGLIAQIEKGKPFFEKISRNIYLRAIRDGFIAGMPVILFSSIFILIAYVPNAWGFHWSKDIENLLMTPYNYSMGILGLFVAGTTAKALTDSMNRSLPSTNQINFISTMLAAIVGFLLMAANPAKDGGFLTGFMGTKGLLTAFIAAFITVNVYKACVKNNVTIRMPEEVPPNISQVFKDLIPFTLSVVLLYVIELIVHTTLGVNVAESIGKLLAPLFQAADGYVGITIIFGAFAFFWFVGIHGPSIVEPAIAAITYANAETNLQLLQAGEHADKILTSGTQMFIVTMGGTGATLVVPFMFMWLTKSKRNKAIGRASVVPTFFGVNEPILFGAPLVLNPIFFIPFILAPIVNVWIFKFFIDTLGMNSFTANLPWTTPAPLGLILGTNFQVLAFILAALLIVVDVIIYYPFLKVYDEQILAEEAAGTNSSDALKEKVAANFDTKKADAILEKSAAKETKEITDQTNVLVLCAGGGTSGLLANALNKAAKEYGAPVTAAAGSYGAHREILPQYQLVILAPQVASNYEDMKVETDKLDIKLAKTEGAQYIKLTRDGQGALDFVKAQFEN

SEQ ID NO: 9273 - DNA, 876 bp, Streptococcus pyogenes
atgtcaattgaccaacgtttacagttaaagaaattttgctttattattttaggagctgctatctacgcctttgcttttgtttatttttacatggctaatcgcattgcagccaatggtttagctggtctcaccctagttggtaaggcactttttgagattgatccttctttgataggctatttgattaatttgcctttggtcttgctgggagctagatgttttgggaaaagagccatggtttacacagtaacgggtattttatcactttacttttttgtgtggctgtttcaacgctttcctttggtcgttgacttggaccatgacaatttagtcgtttccttgatggctggaattattggtggtctaggtggcggtcttgtgtttcgcaatggtggaaccatcggtggagcagatattattgctaagttattagaagacaagttaggactacagctgaatcaagctcttttaggcattgatctttttgtcatgattgtctctttgacttatatttccctgccgcaaatgatgtatgctctgattgctagctttatgtatggtcaaattgttcgcttggtacaacaaggtggttattcagcccgtggcatttttatcgtttcagaacaagcggagaaaattgcccggttcatcatggacgaattgggaagaggagttacttatctaacaggtgaaggagcctactctggtcgccgtaaaaaagtgatttatgtggctttggggcgaagagatattagggaattaaaagcttttttaactcaggttgatcccaatgcctttatcacttattttgatgttaatgaagtcaatagcccagaatttttaactattaaaagcaaataccataaaaagagaaaa

SEQ ID NO: 9274 - protein, 292 aa, Streptococcus pyogenes
MSIDQRLQLKKFCFIILGAAIYAFAFVYFYMANRIAANGLAGLTLVGKALFEIDPSLIGYLINLPLVLLGARCFGKRAMVYTVTGILSLYFFVWLFQRFPLVVDLDHDNLVVSLMAGIIGGLGGGLVFRNGGTIGGADIIAKLLEDKLGLQLNQALLGIDLFVMIVSLTYISLPQMMYALIASFMYGQIVRLVQQGGYSARGIFIVSEQAEKIARFIMDELGRGVTYLTGEGAYSGRRKKVIYVALGRRDIRELKAFLTQVDPNAFITYFDVNEVNSPEFLTIKSKYHKKRK

SEQ ID NO: 9275 - DNA, 1992 bp, Streptococcus pyogenes
atgttatcaaaaaaagaactggccatcataacatttctaatccatcacaaagagcagtttgtctctagtgcaactctggctgaggttatcggtatgagtgaccgtacggttaggaaatacctcaaagaactgatcagtagccttcctgaacacggagctcacatcatttctaaacaaggtcgaggttactgcttagaaattgaccattctatggcatttgacatcttttggcaagaaagtgtgacgtctaaaaaacgtttggcagatgtgactcaagtggaagaatcggttgatcgagaagattatgtgcttcataaattcttttttgaagatgccgttcaggattttgaagagctttgtcaagaattgtatatcagtcggacaactttaaaacatgttttagcaggtattaaggagcgcataataccttaccagttagagcttgaaataactcaccaacatattcaaataagaggtaaagaagaggacattaggcattttatcatggactatttttttgttactagttttgataataccttgtccaccatggtaggtaatacctttcttgaaggtattaattttgcagaaatcatgattattgtcttggatgaatgtcgggatgctaagttgaaactttctgattttgtcatgaataatctagtcttgcatattgccctaatggttcagcgtattcgatcggggtgtccattagaactgttttccattccaatagctattcgtcagtctgatgagtatcaagtagctctgcgcattttgtatcgagtggaagaagtgatggggatacgttttcctaaagaggaggctaattatattgcactgcatctaaaggtcaaacattctgttggtaagcattggcaagatgataataccgatgaaaagttgcaggaccatttaaaagcatgtattgccaagattagtcaattgacaggcatgactttagaaacagataccaatttatttcaaggtttattagcccacatgatgcccttgaccatacgtcttgaaaaccatattcagctgactaatcctttaactgaggaaattaaaagccagtatcctgaaatatttacccttaccaagcagaccttttcggatttgcttgtatgtcaaaagaatgatgtctcagatgatgaatgggcttatattagtttgcatttaatggcggccattgagcgttattcaaaccgtcataaattgagggttctagtagtttgtgccacaggttatggtagtgccatgatgttgaaaaatcgcttggaaaaggaatttgaaggacgtttgcgtattgtcgatgttatcagttactatgaaataaccgaagagcgactgaaaaccgttgatttgattatttcctctatcagccttgccaatctgatgtttttaacaccagtgattactgtcagtgtttttttgtcaaatcaggatattgaaactattcgacaatttattggagaacaagaaggtatcaagaaagaggtcagtttaccgtcacagatgagtttagcaaaagcagagcagcttctaacaggtgtttttagccctaatcgttttctttatttagacgagaaaatctcaaaggaagacttgcttttacggatgattgcttgtcttgacgaggcgggaacagaaacgtttgtagaggacttctatcatcaaatggtactgagggaaaattacagcccagtcatctatggagaagtgcttgcctttccgcatcctgctaatcccatgacttattctgaacaggtagtagtggttatttgccgagagcctcttgagtgggacaaggcgcatcaagctgttcattttgtctttctattatccccgtctaaagggcataatcataggttaaaatatgtatcaccaggtttggcatcttttgtcaatcaggtggagcttcagcaagcgttactagaagaaccaaattattccaaattcatgacagtgtttaccccacttattcatgat

SEQ ID NO: 9276 - protein, 664 aa, Streptococcus pyogenes
MLSKKELAIITFLIHHKEQFVSSATLAEVIGMSDRTVRKYLKELISSLPEHGAHIISKQGRGYCLEIDHSMAFDIFWQESVTSKKRLADVTQVEESVDREDYVLHKFFFEDAVQDFEELCQELYISRTTLKHVLAGIKERIIPYQLELEITHQHIQIRGKEEDIRHFIMDYFFVTSFDNTLSTMVGNTFLEGINFAEIMIIVLDECRDAKLKLSDFVMNNLVLHIALMVQRIRSGCPLELFSIPIAIRQSDEYQVALRILYRVEEVMGIRFPKEEANYIALHLKVKHSVGKHWQDDNTDEKLQDHLKACIAKISQLTGMTLETDTNLFQGLLAHMMPLTIRLENHIQLTNPLTEEIKSQYPEIFTLTKQTFSDLLVCQKNDVSDDEWAYISLHLMAAIERYSNRHKLRVLVVCATGYGSAMMLKNRLEKEFEGRLRIVDVISYYEITEERLKTVDLIISSISLANLMFLTPVITVSVFLSNQDIETIRQFIGEQEGIKKEVSLPSQMSLAKAEQLLTGVFSPNRFLYLDEKISKEDLLLRMIACLDEAGTETFVEDFYHQMVLRENYSPVIYGEVLAFPHPANPMTYSEQVVVVICREPLEWDKAHQAVHFVFLLSPSKGHNHRLKYVSPGLASFVNQVELQQALLEEPNYSKFMTVFTPLIHD

SEQ ID NO: 9277 - DNA, 1776 bp, Streptococcus agalactiae
atgagaataaaatggttttctttggtacgtataacaggactactacttgttttactttaccatttctttaagaatagttttccaggaggatttgttggcgttgacatcttctttacattttctggttttctgattacggccttattgattgatgaattttctaaaacgaaaaaaattgattttgttagtttttgtcgtagacgtttttaccgtattttcccaccattagtattgatggttttggtgacaataccttttgtatttctggttaaaagcgattttagagcaagtattggctctcaaattatgactgctttaggttttaccagcaacttttacgaaatcttgactggtggtaactacgaaagtcaatttatccctcacttatttgtgcatacctggagtctttctattgaagtccatttttatgttttatggggcttaacggtatggctcttatcgaaaagatcaaaagatcaaaagcaattgagggggactttgttccttatttccatgggaatttttggagtcagcttccttaccatgtttgttagagcctttttcgttgataatttttcaacgatatatttctctacattatcacatatatttccgttctttttaggagcgatggtggctacaatatctggtattcgagagattaccggacgattcaagaaaaatatcaaaaatctgactttgaagcataatttaatcatgatgggtagtgcttttgctggtctaatgattttaacttttgcacttgattttgataatcggctaacatatctttttggttttgtattgtctagcatttttgctagtgtaatgatttacaatgcacgtattttacacgagcatacaccagatatttcagaaccttttgtgattacttatcttgctgatatcagttacggtatgtacctttttcattggccattttatattatttttagtcgtttatccccaaactggatagctgttattttgacagtagtattatcagcagtcttctcaacattatcattttatatcattgaaccttttattttaggtagaaaacctaaattccttgattatgaatttgacttgttgccttacaaaaagtggttatttagtatcggaggggtactaactcttattactgtagtgacaatgttgacagctccaagtataggtagttttgagacagaattattgcagaattcgttacaacaagctagaacaaatactaaccgaacacatacactagccgcaggggatgcaggtgctcttagtgatgtgacagtaatcggagattcagttgccttaaggtcaagtgctgcttttaataaattgttaccagaagtacaattagatgctgcggtgagtcgtaattttagtaaatcatttgatatttttgaaaaccgtattcaaaataaagccttgtccaaaattgttgttttggcagttggtgtgaattcattagataactacaagacagacttgagccaatttattaaatctttgcctaagggacaccgtttgattatagtaacaccttataatgctaaaaatatgagtcaagttacgacagtgcgtgattatgaactctcgctaatgaaaaaatataattacataacggttgctgactggtataaggttgcgacagaacatccagaaatctggggaaatacagatggtgtgcattatagtgatagcgatactacaggggctgatttatatgttagtaacgtcaaaaaagctattcaaaaatcagctcaacgagctgcaaaa

SEQ ID NO: 9278 - protein, 592 aa, Streptococcus agalactiae
MRIKWFSLVRITGLLLVLLYHFFKNSFPGGFVGVDIFFTFSGFLITALLIDEFSKTKKIDFVSFCRRRFYRIFPPLVLMVLVTIPFVFLVKSDFRASIGSQIMTALGFTSNFYEILTGGNYESQFIPHLFVHTWSLSIEVHFYVLWGLTVWLLSKRSKDQKQLRGTLFLISMGIFGVSFLTMFVRAFFVDNFSTIYFSTLSHIFPFFLGAMVATISGIREITGRFKKNIKNLTLKHNLIMMGSAFAGLMILTFALDFDNRLTYLFGFVLSSIFASVMIYNARILHEHTPDISEPFVITYLADISYGMYLFHWPFYIIFSRLSPNWIAVILTVVLSAVFSTLSFYIIEPFILGRKPKFLDYEFDLLPYKKWLFSIGGVLTLITVVTMLTAPSIGSFETELLQNSLQQARTNTNRTHTLAAGDAGALSDVTVIGDSVALRSSAAFNKLLPEVQLDAAVSRNFSKSFDIFENRIQNKALSKIVVLAVGVNSLDNYKTDLSQFIKSLPKGHRLIIVTPYNAKNMSQVTTVRDYELSLMKKYNYITVADWYKVATEHPEIWGNTDGVHYSDSDTTGADLYVSNVKKAIQKSAQRAAK

SEQ ID NO: 9279 - DNA, 1014 bp, Streptococcus agalactiae
atgaaagcggttgttgttaatcaagctagtacaggtgttgaagttgttgagcatgatcttccaaaagttggtcatggtgaagcacttgtaaaagtagaatactgtggtgtatgccatactgatttacacgttgcacatggagatttcggccaggtaccaggacgcattttgggtcacgaaggcattggtatagtagaagaaattggagaaggcgtaacgtctttgagggttggtgatcgtgtctctattgcatggttctttgaagggtgcggtcattgcgaatactgtactacaggacgtgagacactttgtcgtagtgttaaaaatgctggatacagtgttgatggtggtatgagtgaatacgctattgttaccgcggactatgcggttaaggttcctgagggattagacccagctcaagcatcatcaatcacttgtgctggagtaacaacatacaaggctatcaaagaagctggagctgctcctggtcagtggattgcagtgtatggtgcaggtggtcttggaaacttagcagtccaatatgcaaaaaaagtattcaatgctcatgttgtagctgttgatattaacgcagataaacttcaattagctaaagaggttggagcagatttgacagttaatggcaaagaaataaaagatgttgcggcatatattcaagaaaagacaggcggttgtcatggagtggttgtgactgctgtttctaaagttgcgtttaatcaggcgattgacagcgttcgtgctggaggtacagtggtagctgtcggtcttccatcagaatatatggaattgagtattgtaaaaacagtacttgatgggattcgtgtggttggttccttagttggaactcgtaaagacttagaagaagccttcgcatttggagcagaaggcttggtagtaccggtggttgaaaaagtgcctgtggatacagctcctcaagtattcgatgaaatggaaagaggattgattcaaggacgtaaagttcttgactttacaaag

SEQ ID NO: 9280 - protein, 338 aa, Streptococcus agalactiae
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 9281 - DNA, 381 bp, Streptococcus agalactiae
ttggctaaaccaacacgcaaacgtcgtgtgaaaaagaacatcgaatctggtgttgctcatattcacgctacattcaataacactattgttatgattacagatgtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgta

SEQ ID NO: 9282 - protein, 127 aa, Streptococcus agalactiae
MAKPTRKRRVKKNIESGVAHIHATFNNTIVMITDVHGNALAWSSAGALGFKGSRKSTPFAAQMAAEAAAKSAQEHGLKTVEVTVKGPGSGRESAIRALAAAGLEVTAIRDVTPVPHNGARPPKRRRV

SEQ ID NO: 9283 - DNA, 1281 bp, Streptococcus agalactiae
atgtctacatcatttgaaaataaagctacaaaccgtggtattatcacatttacaattagtcaagatgagatcaagccagctcttgatcaagcattcaacaaagtaaaaaaagatttgaacgttccaggattccgtaaaggacatatgcctcgtacagttttcaaccaaaaatttggtgaagaagcactctacgaaaatgcattgaatttagtgttgccaaaggcttacgaagcagctgttgcagaacttggtttagacgttgttgctcaaccaaaaattgatgttgtatcaatggaaaaaggtcaagattggaagttgacagctgaagttgttacaaaaccagaagttaaacttggagattacaaagacctttcagtagaagttgatgcttcaaaagaagtttcagatgaagaagttgatgctaaagttgaacgtgagcgtaacaaccttgcagaattgactgttaaagatggtgaagcagcacaaggtgatacagttgttattgactttgtaggttcagttgatggtgttgaatttgatggtggtaaaggagataacttctcacttgaacttggttcaggtcaatttatcccaggatttgaagaacaattagtaggttctaaagctggtcaaactgtagacgttaatgtaacattcccagaagattatcaagcagaagatcttgctggtaaagatgctaaatttgttacaacaattcacgaagtaaaaactaaagaagttccagcacttgatgatgaacttgcaaaagatattgatgatgaagttgaaacacttgatgagttgaaagcgaaatatcgcaaagagctagaatcagcaaaagaaattgcatttgatgatgcagttgaaggtgcagcaatcgaattagctgttgccaatgcagaaattgttgaattaccagaagaaatggtccatgatgaagtacatcgtgctatgaatgagttcatgggtaatatgcaacgtcaaggaatttcaccagaaatgtacttccaattaacaggtacaactgaagaagaccttcataagcaataccaagcagatgctgacaaacgcgttaaaactaaccttgttatcgaagcaattgcagctgcagaaggctttgaagcaacagatgaagaaatcgaaaaagaaatcacagatcttgcttcagaatacaatatggaagctgaccaagtacgcggtctactttcagcagatatgcttaaacatgatattgcaatgaaaaaagcggttgacgttatcactagctcagctactgtaaaa

SEQ ID NO: 9284 - protein, 427 aa, Streptococcus agalactiae
MSTSFENKATNRGIITFTISQDEIKPALDQAFNKVKKDLNVPGFRKGHMPRTVFNQKFGEEALYENALNLVLPKAYEAAVAELGLDVVAQPKIDVVSMEKGQDWKLTAEVVTKPEVKLGDYKDLSVEVDASKEVSDEEVDAKVERERNNLAELTVKDGEAAQGDTVVIDFVGSVDGVEFDGGKGDNFSLELGSGQFIPGFEEQLVGSKAGQTVDVNVTFPEDYQAEDLAGKDAKFVTTIHEVKTKEVPALDDELAKDIDDEVETLDELKAKYRKELESAKEIAFDDAVEGAAIELAVANAEIVELPEEMVHDEVHRAMNEFMGNMQRQGISPEMYFQLTGTTEEDLHKQYQADADKRVKTNLVIEAIAAAEGFEATDEEIEKEITDLASEYNMEADQVRGLLSADMLKHDIAMKKAVDVITSSATVK

SEQ ID NO: 9285 - DNA, 924 bp, Streptococcus agalactiae
atgaaaaagattcgattatcaaagtttattaaaatgattgttgttattttgtttttaattagtgtagcagctagtttttattttttccacgttgcccaagttcgagatgataaatcctttatttcaaatggtcaacgtaagcctggaaactctttatatgcttatgataaatcctttgataagctattaaagcaaaaaatagaaatgacaaaccaaaatataaagcaagttgcttggtatgttcctgctgttaagaaaactcataagacagctgttgtcgttcatggttttgcgaatagcaaagagaatatgaaggcatatggttggctgtttcataagttaggatacaatgttcttatgcctgacaatattgcacatggtgaaagtcatgggcagttgataggctatggctggaacgaccgcgagaacattatcaaatggacagaaatgatagttgataagaatccatcaagccaaattactttatttggtgtttcaatgggtggagcaacagtcatgatggctagtggtgaaaaattacctagtcaggttgttaatatcattgaagattgcggttattctagtgtttgggatgaattaaaatttcaggctaaagagatgtatggtttaccagccttcccactcttatatgaagtttcaacaatttctaaaatcagagcaggtttttcgtatggacaagcaagtagtgtcgaacaattgaaaaagaataatttaccagccctctttattcatggtgataaggataattttgttccaacaagtatggtttatgacaactataaagctacagcaggtaagaaagagctttatattgtaaaaggggcaaaacatgcgaaatcttttgaaacagagccagaaaaatatgagaaacgtatctctagttttttgaaaaaatatgaaaaa

SEQ ID NO: 9286 - protein, 308 aa, Streptococcus agalactiae
MKKIRLSKFIKMIVVILFLISVAASFYFFHVAQVRDDKSFISNGQRKPGNSLYAYDKSFDKLLKQKIEMTNQNIKQVAWYVPAVKKTHKTAVVVHGFANSKENMKAYGWLFHKLGYNVLMPDNIAHGESHGQLIGYGWNDRENIIKWTEMIVDKNPSSQITLFGVSMGGATVMMASGEKLPSQVVNIIEDCGYSSVWDELKFQAKEMYGLPAFPLLYEVSTISKIRAGFSYGQASSVEQLKKNNLPALFIHGDKDNFVPTSMVYDNYKATAGKKELYIVKGAKHAKSFETEPEKYEKRISSFLKKYEK

SEQ ID NO: 9287 - DNA, 939 bp, Streptococcus agalactiae; identical to SEQ ID NO: 8977

SEQ ID NO: 9288 - protein, 313 aa, Streptococcus agalactiae
MKNMMKYISELTTLIALAGLMVIITLINPNFLTTNNLLNLLLQVTANGFIAFGMTFVILTGGIDLSVGSILALSSALTAGLIGHGVPVGIAIVLSVALGGILGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 9289 - DNA, 879 bp, Streptococcus agalactiae
atggcaatcgtttcagcagaaaaattcgtccaagcagctcgtgataacggctatgcagtaggtggatttaacacaaacaaccttgagtggactcaagctatcttgcgcgcagcagaagctaaaaaagctccagtacttatccaaacttcaatgggtgcggctaaatacatgggtggttacaaactttgtaaacaacttattgaaactttggttgaatcaatgggtattactgtaccagttgctatccaccttgaccacggtcattacgatgatgcccttgagtgtattgaagtaggttacacttcaattatgtttgatggttcacaccttccagttgaagaaaaccttgaaaaagcacgcgaagttgttgctaaagcacatgctaaaggtatttcagtagaagctgaagttggtactatcggtggtgaagaagatggtattgtcggtaaaggtgaattagcaccaatcgaagacgctaaagctatggttgaaactggtattgacttcttggctgcaggtatcggtaacattcatggaccatacccagcaaactgggaaggacttgaccttgatcacttgaagaaattgactgaagctgttcctggtttcccaatcgtgttacacggtggttcaggtattcctgatgatcaaatccaagaagctatcaaacttggtgttgctaaagttaacgttaacacagaatgtcaattagctttctgtcaagcaactcgtgactacgctgttgaattcaacgctaacgaagctgaatacatgaagaaaaaactctttgacccacgtaaattcttgaaacctggtttcgatgcaattacagaagcagttgaagaacgtattgacgtgtttggttcagcaaacaaagca

SEQ ID NO: 9290 - protein, 293 aa, Streptococcus agalactiae
MAIVSAEKFVQAARDNGYAVGGFNTNNLEWTQAILRAAEAKKAPVLIQTSMGAAKYMGGYKLCKQLIETLVESMGITVPVAIHLDHGHYDDALECIEVGYTSIMFDGSHLPVEENLEKAREVVAKAHAKGISVEAEVGTIGGEEDGIVGKGELAPIEDAKAMVETGIDFLAAGIGNIHGPYPANWEGLDLDHLKKLTEAVPGFPIVLHGGSGIPDDQIQEAIKLGVAKVNVNTECQLAFCQATRDYAVEFNANEAEYMKKKLFDPRKFLKPGFDAITEAVEERIDVFGSANKA

SEQ ID NO: 9291 - DNA, 1662 bp, Streptococcus agalactiae
gtgtcaaagattacgacaagtttattccaagaaatggtacaagctgccagtacacgtctgagtaaacaggcagagtatgtcaactcattaaatgtattcccagttccagatggtgatactggtacgaatatggggatgactatggaaaacggagccaaggaagtttcggacaaaccagcgacgactgttggagaagttggtcaaattctttctaaaggtgtattgatgggagcacgtggaaattcaggtgtaattacatcacaattattccgtggttttggtcaaagtatcaaggataaagaagaattaacgggtcaagatttggcacacgctttccagaatggtgttgaagtagcttataaagccgttatgaaaccagttgaaggaactatcttgacagtatcacgcggtgcagctaccgctgctctaaaaaaagctgaagaaactgatgatgcagttgaagttatgcgcgcaactctcaaaggtgctaagcgtgctcttgctaaaacaccggatatgctacctgttcttaaagaggttggtgttgttgattctggtggtcaaggactcgtctttatttacgaaggtttcctctcagcactgactggggaatatatcgcatcagaagattttaaagcaactcccgcaacaatgactgaaatggttaatgcagagcaccataaagctgtagtaggccacgtagccacagaagatattaaatatggctattgtacagaagtcatggttggtttaaagcaaggaccaacttacgttaaggaatttaactacgaagaatttcaaggttatcttagcaatctaggggattctttactagttgttaatgatgatgaaattgtcaaggttcatgttcatacagaagatccaggtcttgttatgcaagaaggtttgaaatatggatcgcttgtgaaggttaaagttgaaaacatgcgtaaccaacatgatgcccaaatgcaaaaggttgaagttgaagaaactgtcaaagaaactaaagaatatggtattattgctgttgtagctggtgacggtctagctgagatttttaaatcacaaggtgttgattatatcatctctggcggccagactatgaacccatctacagaagatattgtaaaagcgattgaaaaagtaaacgctagaaatgttattattttaccaaacaataagaacatcttcatggctgcacagtcagctgcagatgtcgttgatattccagcagcagtagtagagacacgtacagttccacaaggatttactagcttacttgcttttgatcctgctaagtctcttgaaactaatgtagctgatatgacaaatagcctctcagatgtcattagtggtagtgtgactttagctgttcgtgatacaacgatagatggccttgaaattcatgaaaacgacatccttgggatggttgatggtaaaattctagtatctacaccagatatggaaaaagcacttaaagacacttttgataaaatgattgatgaagatagtgaaatcgtgacaatctatgttggtgaagatggtaagcaagcattagctgagaccttgtcggaatatcttgaggaaacttatgaagatgttgaagttgagatccaccaaggagatcaacctgtatatccatacctcatgagcgttgaa

SEQ ID NO: 9292 - protein, 554 aa, Streptococcus agalactiae
MSKITTSLFQEMVQAASTRLSKQAEYVNSLNVFPVPDGDTGTNMGMTMENGAKEVSDKPATTVGEVGQILSKGVLMGARGNSGVITSQLFRGFGQSIKDKEELTGQDLAHAFQNGVEVAYKAVMKPVEGTILTVSRGAATAALKKAEETDDAVEVMRATLKGAKRALAKTPDMLPVLKEVGVVDSGGQGLVFIYEGFLSALTGEYIASEDFKATPATMTEMVNAEHHKAVVGHVATEDIKYGYCTEVMVGLKQGPTYVKEFNYEEFQGYLSNLGDSLLVVNDDEIVKVHVHTEDPGLVMQEGLKYGSLVKVKVENMRNQHDAQMQKVEVEETVKETKEYGIIAVVAGDGLAEIFKSQGVDYIISGGQTMNPSTEDIVKAIEKVNARNVIILPNNKNIFMAAQSAADVVDIPAAVVETRTVPQGFTSLLAFDPAKSLETNVADMTNSLSDVISGSVTLAVRDTTIDGLEIHENDILGMVDGKILVSTPDMEKALKDTFDKMIDEDSEIVTIYVGEDGKQALAETLSEYLEETYEDVEVEIHQGDQPVYPYLMSVE

SEQ ID NO: 9293 - DNA, 1656 bp, Streptococcus agalactiae
atggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaataat

SEQ ID NO: 9294 - protein, 552 aa, Streptococcus agalactiae
MAKQKNNWRRVGVGVLTLASVATLAACGSKSASQDSNGAINWAIPTEINTLDLSKVTDTYSNLAIGNSSSNFLRLDKDGKTRPDLATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKNN

SEQ ID NO: 9295 - DNA, 975 bp, Streptococcus agalactiae; identical to SEQ ID NO: 8471

SEQ ID NO: 9296 - protein, 325 aa, Streptococcus agalactiae
MKHITTVVIWKILRCLSLVFGVSILTFILLKQSPVDPVMASVNYDTSLTPVQYKAIAHHYGLDKPAPVQYFIWLKNFIQGHLGTSLVYRQPVIDIIRSRAGASFILMGLSWVLSGLIGFILGTLSAFHQGKLLDRIVRWFSYLQISVPTFWIGLIFLLIFSVQLGWFPIGISSPIGTLSQDITLADRIKHLILPVFTLSILGIANVTLHTRTKMMSVLSSEYVLFARARGETEWQIFKNHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 9297 - DNA, 1146 bp, Streptococcus agalactiae
atgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgaaagatggaggtaatttagctggttctattcttaagctcaaagatggattaaaaaatgttgtagaatggggaattgctactccggaagaggcagtgcgtatggcgagttatgttccggcagtgtctgtaggcattgataatgtctgtggacagataaaagaaggttatgcagcggattttattgtattagataaacatctagatttagttgcaacataccttgatggggaaaaacgttggcaatct

SEQ ID NO: 9298 - protein, 382 aa, Streptococcus agalactiae
MTKYIKADRFFYADHVKENGYLEIKDNHFGKWIENISGQEEILDYSGYQIAPGLVDTHIHGFAGADVMDCDSEGILRMSAGLLSTGVTSFLPTTLTSDTKRLEEASKSVAAVAGKEQGAKIQGIYFEGPYFTEEYKGAQNPIYMRNPNLEEFAQWQKAAKGLITKIALAPEREGVEEFVSAITKQGVTVALGHSNGTYKEAKKAVKAGASVWVHAYNGMRGLTHREPGMVGAVYNLPNTYAELICDGHHVDPVACDILMTQKGHNHVALITDCMAAGGAPDGDYMLGELPVVVSNGTARLKDGGNLAGSILKLKDGLKNVVEWGIATPEEAVRMASYVPAVSVGIDNVCGQIKEGYAADFIVLDKHLDLVATYLDGEKRWQS

SEQ ID NO: 9299 - DNA, 753 bp, Streptococcus agalactiae
atgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtacca

SEQ ID NO: 9300 - protein, 251 aa, Streptococcus agalactiae
MNRLENIISLVSQYQKIDVNTLSELLQVSKVTIRKDLDKLEGKGLLHREHGYAVLNSGDDLNVRLSFNHKTKKEIAALAANMVSDNDTILIESGSTCALLAENICQTKRNVTILTNSCFIANYLREYDSCQIVLLGGEYQSSSQVTVGPLLKKMISLFHVSLAFVGTDGFDPKLGFMGRDLMRSEVAQEMANAADEVIILTDSSKFNQTALVEQLPLSTVSQVITDKHPNSEIANLFQEAEITIQSLLQVP

SEQ ID NO: 9301 - DNA, 810 bp, Streptococcus agalactiae
atggcggatatttcaattatctcaatgattttggtcgttatcgttgccttctttgctggtcttgaaggtatcctcgaccaattccaaatccatcaacctcttgttgcttgtactttaatcggtcttgtaactggtcacctcgaagcgggtattattcttggtggtagtctccaaatgattgctcttgcttgggcaaatatcggagctgccgtagcaccagacgctgcacttgcctctgttgctgctgctattattttggttaaaagtggtgacttcactcaaaaaggtatcaactttgccttctctactgctgtacctctagctattgctggacttttccttacaatgattgttcgtacaatctcaactgcacttgttcacgctggtgacaaagctgcttctgaaggaaacttcgcagcaattgaacgttttcactttatcgccctccttctccaaggattacgtattgcattcccagctgcgcttcttttagctattccatcttcttcagtacaaagtattcttgaagcaatgcctgattggttaaatggtggtatgcaagttggtggtgccatggttgttgccgttggttacgctatggttatcaatatgatggctactcgcgaagtttggcctttctttgctcttggatttgctctagcagctttgaaccagttaactcttattgcaatgggtactattggtgttgctatcgccctcatctacatcagtttatcaaaaatgggtggaagcaaaggtacttctaacgcaggttctaacgatcctatcggcgatatcttagaggactac

SEQ ID NO: 9302 - protein, 270 aa, Streptococcus agalactiae
MADISIISMILVVIVAFFAGLEGILDQFQIHQPLVACTLIGLVTGHLEAGIILGGSLQMIALAWANIGAAVAPDAALASVAAAIILVKSGDFTQKGINFAFSTAVPLAIAGLFLTMIVRTISTALVHAGDKAASEGNFAAIERFHFIALLLQGLRIAFPAALLLAIPSSSVQSILEAMPDWLNGGMQVGGAMVVAVGYAMVINMMATREVWPFFALGFALAALNQLTLIAMGTIGVAIALIYISLSKMGGSKGTSNAGSNDPIGDILEDY

SEQ ID NO: 9303 - DNA, 306 bp, Streptococcus agalactiae
atgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggag

SEQ ID NO: 9304 - protein, 102 aa, Streptococcus agalactiae
MQEYFGIGLDSSSRCYHYHTKLDIVALKCAVCQKYYACYKCHDALEEHCFAATKSDETFPVLCGSCRQMLTLKEYKTGFCPYCRMLFNPNCQRHDSIYFSKE

SEQ ID NO: 9305 - DNA, 1347 bp, Streptococcus agalactiae
atgacacatattacatttgactattcaaaagtcttgggtcaatttgtaggcgaacacgagttagactacctacaaccacaagtaagtgcagcagatgctttccttcgtcaagggactggtcctggctcagattttctcggatggatggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctt

SEQ ID NO: 9306 - protein, 449 aa, Streptococcus agalactiae
MTHITFDYSKVLGQFVGEHELDYLQPQVSAADAFLRQGTGPGSDFLGWMDLPENYDKEEFSRIQKAAEKIKSDSEVLVVIGIGGSYLGAKAAIDFLNNHFANLQTAEERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVVRVEKPRKNVTIPELTEDLDGLGYLQGKDVDFVNKKATDGVLLAHTDGGVPNMFVTLPTQDAYTLGYTIYFFELAIGLSGYLNSVNPFDQPGVEAYKRNMFALLGKPGFEELSAELNARL

SEQ ID NO: 9307 - DNA, 1080 bp, Streptococcus agalactiae
gtgaatagagaggttactatgtcaatagaatcagattttttccggaaaaaacgttttattttttcatcgcttgaggagtttggatttatcaaatctgaccaagagtatatctattgtcaaacatttatggataatgactttaaagctattatcacgatttcattggatggaaagatagctggtaaggttattgattcggcacttgaagaagaatatttaccgcttcgagcagcaaattataatggttcgtttgttggcgaagtacgatcggcttatatggctatattaggtgatatttcagattcttgttgtaaggacttattatttaccaaagatcaaagtaatcgtttagcggagaagatagctaaaacttttgaagattcagttgattatccatttgcgaagcacccacaatatgcttcctatcgtgtgtcaggtaaatggtatgctctgctttttccattgaagatggggaaactagaaaatgttccagctcaactgtcagaagatgaggttgaagttttgaatattaaagtcaatcctcaagatatggaaatacttttacaaaaagaaggtatttatccttcttatcatatgtctaaaaagacttgggtatctatcgttttagacaatactttgtctgatatagaaatttttaaattggtatcagatagtcgtaagcttgtttctcacaataaaaaatcaaattctgagccagagttttggattattcctgctaatcctaaattttacgatattgataaggagtttgcagagcatcaattgattgattggactcaaaaaggaaagattgcggtgggagattatgtgtttatttatattacagcacctattcgtgcttttcgctatgtctgtcaagtgatagaacgtgaccttaaaacaagtacttacttaggagcaagagatgtcaaagcttatatgcgactcaaactgataaggcaatttgaagattctacctatcctgtagcatttttagcagaacacggcgttaagactgtgagaggaccacggcgaatgaccaaggaattgcgacaagtcatggcaaaaacaattctagag

SEQ ID NO: 9308 - protein, 360 aa, Streptococcus agalactiae
MNREVTMSIESDFFRKKRFIFSSLEEFGFIKSDQEYIYCQTFMDNDFKAIITISLDGKIAGKVIDSALEEEYLPLRAANYNGSFVGEVRSAYMAILGDISDSCCKDLLFTKDQSNRLAEKIAKTFEDSVDYPFAKHPQYASYRVSGKWYALLFPLKMGKLENVPAQLSEDEVEVLNIKVNPQDMEILLQKEGIYPSYHMSKKTWVSIVLDNTLSDIEIFKLVSDSRKLVSHNKKSNSEPEFWIIPANPKFYDIDKEFAEHQLIDWTQKGKIAVGDYVFIYITAPIRAFRYVCQVIERDLKTSTYLGARDVKAYMRLKLIRQFEDSTYPVAFLAEHGVKTVRGPRRMTKELRQVMAKTILE

SEQ ID NO: 9309 - DNA, 990 bp, Streptococcus agalactiae
atgaagaaaagctttattcatcagcaacaggagatttcttttgtcaaaaatacttttacacaatatttgattgataagttagaaatcgtcgaagtgcaaggacctattcttagtcaggtcggggatggtatgcaagataatttatctggtattgaacatcctgtatcggtgaaagtccttaatatacctgaagctgaatttgaagtcgttcactcattggctaaatggaaacgccatactttggcaagatttgggtttaatgagggagaaggtctttttgttcatatgaaagctcttcgtccagatgaagattctcttgatccaacacactcagtttacgtagatcagtgggactgggagaaggtcattcctgatggtagacgtaatttggactatctaaaagaaactgtggaaaaaatctacaaagctatccgcctaacagagcttgccgtggaagctcgttttgatattgaatccattttaccaaagcgtattacctttattcatacagaagaattggtagaaaaatacccagacttaagccctaaagagcgtgaaaatgccatcgctaaggagtatggcgcagtctttttgattggtattggtggagagttagcagatggtaaaccacatgatggtcgtgcaccggactatgatgactggacaacaccatcagaaaatggttttaaaggtctcaatggtgatattttagtgtggaacgaacagcttggaactgcctttgaactatcatcaatgggaattcgagttgatgaagatgctcttaaacgtcaagttgttctcaccggtgatgaagatcgtttagagtttgagtggcataagacgctattacgtggtttcttccctctgactattggtgggggaattggtcaatcacgattagctatgttcttgcttcgtaaaaaacatattggagaagtacagtcaagtgtctggccaaaagaagtcagagatacctttgaaaatatatta

SEQ ID NO: 9310 - protein, 330 aa, Streptococcus agalactiae
MKKSFIHQQQEISFVKNTFTQYLIDKLEIVEVQGPILSQVGDGMQDNLSGIEHPVSVKVLNIPEAEFEVVHSLAKWKRHTLARFGFNEGEGLFVHMKALRPDEDSLDPTHSVYVDQWDWEKVIPDGRRNLDYLKETVEKIYKAIRLTELAVEARFDIESILPKRITFIHTEELVEKYPDLSPKERENAIAKEYGAVFLIGIGGELADGKPHDGRAPDYDDWTTPSENGFKGLNGDILVWNEQLGTAFELSSMGIRVDEDALKRQVVLTGDEDRLEFEWHKTLLRGFFPLTIGGGIGQSRLAMFLLRKKHIGEVQSSVWPKEVRDTFENIL

SEQ ID NO: 9311 - DNA, 732 bp, Streptococcus agalactiae
atggttgagccaattatttcaatacaaggacttcataaaagttttgggaaaaatgaggttttaaaaggcattgacttggatattcatcaaggagaagtagtggttattattggcccttctggctctggtaagtcaacatttttaagaacaatgaatctcttggaagtaccaacaaagggaacagtgacttttgaagggattgatataacagacaaaaagaatgatatttttaaaatgcgcgaaaaaatgggcatggtttttcaacagttcaatctatttcccaatatgactgtactagaaaatattactttatcacctattaagacaaaggggctttctaatcttgatgctcagacaaaagcatatgagctacttgaaaaagttggactcaaagagaaggctaatacttatccagctagcttatctggaggacaacaacaacgaattgctattgcaagaggtcttgcaatgaatcctgatgtccttctttttgatgaacctacttcagctcttgatcctgaaatggtaggtgaagtcttgactgttatgcaagatttagctaaatctggtatgacgatggttattgtcactcatgaaatgggttttgcacgtgaagtagcggatcgtgtcatttttatggatgcaggaattattgttgagcaaggggcccctaaggaagtatttgagcagacaaaagaaatccgcacaagagatttcttaagtaaagtatta

SEQ ID NO: 9312 - protein, 244 aa, Streptococcus agalactiae
MVEPIISIQGLHKSFGKNEVLKGIDLDIHQGEVVVIIGPSGSGKSTFLRTMNLLEVPTKGTVTFEGIDITDKKNDIFKMREKMGMVFQQFNLFPNMTVLENITLSPIKTKGLSNLDAQTKAYELLEKVGLKEKANTYPASLSGGQQQRIAIARGLAMNPDVLLFDEPTSALDPEMVGEVLTVMQDLAKSGMTMVIVTHEMGFAREVADRVIFMDAGIIVEQGAPKEVFEQTKEIRTRDFLSKVL

SEQ ID NO: 9313 - DNA, 273 bp, Streptococcus agalactiae
atggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttttggtaactttgaagttcgtgaacgtgcagctcgtaaaggtcgtaacccacaaactggtgcagaaatcgaaattgcagcatcaaaagttccagcatttaaagctggtaaagctcttaaagacgctgttaaa

SEQ ID NO: 9314 - protein, 91 aa, Streptococcus agalactiae
MANKQDLIAKVAEATELTKKDSAAAVDAVFAAVADYLAEGEKVQLIGFGNFEVRERAARKGRNPQTGAEIEIAASKVPAFKAGKALKDAVK

SEQ ID NO: 9315 - DNA, 933 bp, Streptococcus agalactiae
atgattatttttcaacaaattcttgataaaatcaaagagtacgacaccatcattatccatcgacatatgagaccagaccctgatgctcttggtagccaaatcggcttaagggatatcatcaggcataattttccaaagaaaaaagtacttgctactggttttgacgaacccactctcgcttggattgctaaaatggatcaagtgaccgaccaagactatcaaggcgctcttgttgttgttacagatacagcaaataccccacgcattgatgatgaacgttataaaaaaggtgactttttaattaaaattgaccatcatccaaacgatgaagtctatggagatctctcttatgtagatactaacgcctctagtgcaagtgaaattgtgacagactttgctctttcttgtgatttgttgttatcaacaagtgcagcaagagttctatataatggtattgtaggagatacaggacgctttttatatcctgctaccacaagtaaaacactgaagattgctagcaaacttcgtgaatttgactttgatttttctgcaatggcacgtcaaatggattcctttcctttcaaaattgcaaaattacaaggctttatttttgagcaacttaaaattgacaagaacggcgctgcatgcgttactttaacacaagaagacctaaaacgcttcgatgtaacagatgcagagactgctgcaatcgttggtgtacctggaaaaattgatattgtagaaagttgggcaattttcgttgaacaaagcgatgggcattatcgtgtgcgcctacgtagtaagtcacacatcattaatgaaatagctaaacgtcataatggtggcggacatcctttagccagcggagctaattcttatagtttggaagagaatcaagctatttaccaagaaatccaggaaatactttcttta

SEQ ID NO: 9316 - protein, 311 aa, Streptococcus agalactiae
MIIFQQILDKIKEYDTIIIHRHMRPDPDALGSQIGLRDIIRHNFPKKKVLATGFDEPTLAWIAKMDQVTDQDYQGALVVVTDTANTPRIDDERYKKGDFLIKIDHHPNDEVYGDLSYVDTNASSASEIVTDFALSCDLLLSTSAARVLYNGIVGDTGRFLYPATTSKTLKIASKLREFDFDFSAMARQMDSFPFKIAKLQGFIFEQLKIDKNGAACVTLTQEDLKRFDVTDAETAAIVGVPGKIDIVESWAIFVEQSDGHYRVRLRSKSHIINEIAKRHNGGGHPLASGANSYSLEENQAIYQEIQEILSL

SEQ ID NO: 9317 - DNA, 1194 bp, Streptococcus agalactiae; identical to SEQ ID NO: 8577

SEQ ID NO: 9318 - protein, 398 aa, Streptococcus agalactiae
MIKRFDNYAQYVLVLGFSLLIGGVVGAITAVFGRVLLFLTAFRSDYIAYLLPFLSIVGLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYVLPSLIAALTANFVSHSLGLEKFSHSIATSMALTPDIILKLLVLGLCFGLCGNLFAYLLAKAKLIASSRLLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSISHAHTIYGAQSR

SEQ ID NO: 9319 - DNA, 1077 bp, Streptococcus agalactiae
atgtggatagaggagctagccaacgggaaatttaaatatatcgaaagatatactgaccctctaacaaataagtacaaaaaagtatctgtgacactagataaaaattctagtcaagctcagaaaaaagctggtttaatattgcaggaaaagattgaagataggctcgctatcagaaatcactcagaaatgacttacggagaacttaaaaaggaatatctaaagcaatggataccgaccgtcaaagactccacaaaacgtggttatttagtatctgacagtcatatagcaaccgtgttaccagatgatacaattatcaacaagttgactaaacgtgatattagactaatcattgataaactattaaaacacaattcgtatcatgttacgcataaatgtagaaagagattgcatgccatattttcttatgcgatacaaatggactatatgacaagtaatccgacggagaacgtcttagttcccaaaccaaaggatgattacaagcctgaaaaggtgctttatttaacatctaacgaggtttacgacctgtgcaatagaatgatagacaatgacgaacaaacgctcgcagacatcgttttattcatgtttttgacgggtgtacggtatggagaattatcttgtctgacttacgacaaaatagattttgaaaataaagaaattctgattaatgcaacttacgattttaacacacgagaaatcactacgaccaagaccaaaaaatcaacacgcaaaatatctgtatcagataatattttagatatcgtcaatagacagaaaaagacaagttcattcgtctttccaaattcgaacggtgtaccgattttaaacgcgtacatcaataagcgattgaaaatttatggagattatcacacgcacttatttagacactcgcatatatcatttttagcagaaaaagggataccgctaaatgcgataatggatagagttggtcacagcgatccaaaaacaacattatctatttacagtcacacaactgtaaatatgaaagaaattataaataaacaaactgccccttttgtgccccttttaaaatcggaa

SEQ ID NO: 9320 - protein, 359 aa, Streptococcus agalactiae
MWIEELANGKFKYIERYTDPLTNKYKKVSVTLDKNSSQAQKKAGLILQEKIEDRLAIRNHSEMTYGELKKEYLKQWIPTVKDSTKRGYLVSDSHIATVLPDDTIINKLTKRDIRLIIDKLLKHNSYHVTHKCRKRLHAIFSYAIQMDYMTSNPTENVLVPKPKDDYKPEKVLYLTSNEVYDLCNRMIDNDEQTLADIVLFMFLTGVRYGELSCLTYDKIDFENKEILINATYDFNTREITTTKTKKSTRKISVSDNILDIVNRQKKTSSFVFPNSNGVPILNAYINKRLKIYGDYHTHLFRHSHISFLAEKGIPLNAIMDRVGHSDPKTTLSIYSHTTVNMKEIINKQTAPFVPLLKSE

SEQ ID NO: 9321 - DNA, 453 bp, Streptococcus agalactiae
atgactgaacttgacaataaaatcctacaaaaagcaagcggtgaaaatcgtcttgatcctgatcaacaacgttactaccttggtacttataaagaaagagttgtgctccacttaagtttaaaagaggcacaagaagaaaagtttcaacttgctataacatctgctcttaataatctgatacttgaatatcctaatcttagtttaaaattatcaccaaatctccctactgatgttcaaatgttctacatgaagttagctaaccgtctatcactagctgctacgattgttaatgaagcaaatgccaattctccatttggtattattatacatagtgataaggctgaaaacgttgaatggaacgattttgagacacaattccctgatttattcaattcaccaaaaaaagaggagtctcctaaaaaaagtctatggcaacatttctttagtcaaaaa

SEQ ID NO: 9322 - protein, 151 aa, Streptococcus agalactiae
MTELDNKILQKASGENRLDPDQQRYYLGTYKERVVLHLSLKEAQEEKFQLAITSALNNLILEYPNLSLKLSPNLPTDVQMFYMKLANRLSLAATIVNEANANSPFGIIIHSDKAENVEWNDFETQFPDLFNSPKKEESPKKSLWQHFFSQK

SEQ ID NO: 9323 - DNA, 783 bp, Streptococcus agalactiae
atgaaaagattacataaactgtttataaccgtaattgctacattaggtatgttgggggtaatgacctttggtcttccaacgcagccgcaaaacgtaacgccgatagtacatgctgatgtcaattcatctgttgatacgagccaggaatttcaaaataatttaaaaaatgctattggtaacctaccatttcaatatgttaatggtatttatgaattaaataataatcagacaaatttaaatgctgatgtcaatgttaaagcgtatgttcaaaatacaattgacaatcaacaaagactatcaactgctaatgcaatgcttgatagaaccattcgtcaatatcaaaatcgcagagataccactcttcccgatgcaaattggaaaccattaggttggcatcaagtagctactaatgaccattatggacatgcagtcgacaaggggcatttaattgcctatgctttagctggaaatttcaaaggttgggatgcttccgtgtcaaatcctcaaaatgttgtcacacaaacagctcattccaaccaatcaaatcaaaaaatcaatcgtggacaaaattattatgaaagcttagttcgtaaggcggttgaccaaaacaaacgtgttcgttaccgtgtaactccattgtaccgtaatgatactgatttagttccatttgcaatgcacctagaagctaaatcacaagatggcacattagaatttaatgttgctattccaaacacacaagcatcatacactatggattatgcaacaggagaaataacactaaat

SEQ ID NO: 9324 - protein, 261 aa, Streptococcus agalactiae
MKRLHKLFITVIATLGMLGVMTFGLPTQPQNVTPIVHADVNSSVDTSQEFQNNLKNAIGNLPFQYVNGIYELNNNQTNLNADVNVKAYVQNTIDNQQRLSTANAMLDRTIRQYQNRRDTTLPDANWKPLGWHQVATNDHYGHAVDKGHLIAYALAGNFKGWDASVSNPQNVVTQTAHSNQSNQKINRGQNYYESLVRKAVDQNKRVRYRVTPLYRNDTDLVPFAMHLEAKSQDGTLEFNVAIPNTQASYTMDYATGEITLN

SEQ ID NO: 9325 - DNA, 519 bp, Streptococcus agalactiae
ttgatgtcaattttaattgcgatgattttctgtttcttgatcgtatctccaatcacaacagttgggattgctttggcaattagtttgtccggaattggttctggtgctgctaatttaggtatctgtgctgctagttttgggctttgtatggctgggtggtcagtcaattctaaggggacagccttagcgcatgttttagggtctcctaagatttcgatggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatt

SEQ ID NO: 9326 - protein, 173 aa, Streptococcus agalactiae
MMSILIAMIFCFLIVSPITTVGIALAISLSGIGSGAANLGICAASFGLCMAGWSVNSKGTALAHVLGSPKISMANVLAKPKIMLPMISSAAILGILGALFNIQGTPASAGFGISGLIGPINALNLAKGGWSVMNMLLIIIIFVAAPIILNFIFNYLFIKVLKIIDPMDYKLDI

SEQ ID NO: 9327 - DNA, 1266 bp, Streptococcus agalactiae
atgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttatttatcggaactattgcagttgttggagttgagacaatggctaaagtccctgtctttggttatgtagctaagcgatttaatgctttttttgacccatttaaagatttaacagattcaggacaccagttggctaattcgtattatgcaatgagcaacggtggctggtttggtcgaggacttgggaattctattgaaaaattagggtacttaccagaagcaacaacagactttgtcttttcaattgttattgaggaattaggagttattggtgcagggtttattttagctttggttttcttcttaattttacgtattatgcacgtaggtataaaggctaaagatcctttcaactcaatgatcgctcttggtattggagcaatgctattgatgcaagtttttgttaacattggtggtatttctgggttaatcccctcaactggagtgacatttcctttcttatcccaaggagggaacagcctcttggtactttctgtagcgatcggattcgtgcttaatattgatgctaacgagaaaaaggaactcataatgaaagaagcagaagagcaatataagccacaagaaaaaaatgaaaaaataatcaaccttgatgcctttaaa

SEQ ID NO: 9328 - protein, 422 aa, Streptococcus agalactiae
MKIDKRHLLNYSILIPYLILSILGLIVIYSTTSATLIQLGANPFRSVINQGVFWAVSLVAIIFIYKLKLNFLKNSKVLTMAVLVEVFLLLIARFFTQEVNGAHGWIVIGPISFQPAEYLKVIIVWYLAFTFARRQKKIEIYDYQALTKGRWLPRSLSDLKDWRFYSLFMIGLVIAQPDLGNGSIIVLTVIIMYCISGIGYRWFSALLGLIVVGSTLFIGTIAVVGVETMAKVPVFGYVAKRFNAFFDPFKDLTDSGHQLANSYYAMSNGGWFGRGLGNSIEKLGYLPEATTDFVFSIVIEELGVIGAGFILALVFFLILRIMHVGIKAKDPFNSMIALGIGAMLLMQVFVNIGGISGLIPSTGVTFPFLSQGGNSLLVLSVAIGFVLNIDANEKKELIMKEAEEQYKPQEKNEKIINLDAFK

SEQ ID NO: 9329 - DNA, 1536 bp, Streptococcus agalactiae
atgaataaatcattcaataccaaattaggtttggtaactgtagcggtattatcaggtattgtattaacgtctcaattacctgtgaacgctaaagctgagacaccagtaatggcagcaagtgcacaacaaggtttccgttttgtagcaaccgttgtagatagtcagacgcatgtcttgccgggaaaattggtaactttgtcagaggtgacaagtggtcagcctaaaattattgcaagtgtgaaaacgaatgatgccggacaagctatttttaataatctccctataaaacgtaaccttagtgtgtctgttgatggacaagtaaaaggatatactattcgaactgacgtagcaggttctagtaaagcagctagttttacagcaacaggagtagggacaaatgagccaacgtattcaaaaaaaaccatagacatcacagtgagagaccagaatgctgaacctgtttcaggcaggacagttaccttaaaaacacaagctggtcgtgagattgctagcttggtttctggtgacaatggattaactcgctttactgatcgtttactagatggaacattctaccaatattttgttgatgggaaaaaaattggtgatattgtacctggagaatcaagaagtgcatatgttaatgttgcacctaaaaaagattattttacctttacagtcactgctttagataaagatggacttgttgttaagggaaaagaagtaacgttgactgatattactgatggtaaagcagtagcgcttgcttctttaaaaacgaatgataatggacaagctatctttaccaacctaccattatcaagaaatatcagtgtttcaattgatggaaaatcaaagggctatactcttcgaactgatgtagcaggctctcataaagcggctgcattctatgtagatggtaaaggtaccaaagcacctcaatttagtgcagaagcagcggttgtaactgtttacgatgctaatggaaatactatagcaaaccaagaagtgacattaactaattcaaatgggacaattgttgcaaaaggtttgactgaaaaagatggcaaagcaaggttcgccaataaattaatggcaggaacgttatacaatatttttgtaaatggtattgagatgcctaaaactgcccttgttggtagtgatgtcagtgtttttctaacagataaacaaattaagaaagaaaaacctgttactcctgataaattggataaagaaatgaaccaagagaaggaaaaggagctcttagatactccaaaaccagtaccacctacttcgaaaccaacagcaccaattaaaaataaaaaggacgattcccctaagaagttcacgaaaagtcaatcttctagtttgaagtcaagtgttaaggctataggtgctaagccaaaagctatgacagccttagctaaaaaattgcctaaaactggtgatcaagccattagtattttaactttggttggttttattgtaacagggttagcgattatgttaggcttccttaaaaaatcacgatcaaaa

SEQ ID NO: 9330 - protein, 512 aa, Streptococcus agalactiae
MNKSFNTKLGLVTVAVLSGIVLTSQLPVNAKAETPVMAASAQQGFRFVATVVDSQTHVLPGKLVTLSEVTSGQPKIIASVKTNDAGQAIFNNLPIKRNLSVSVDGQVKGYTIRTDVAGSSKAASFTATGVGTNEPTYSKKTIDITVRDQNAEPVSGRTVTLKTQAGREIASLVSGDNGLTRFTDRLLDGTFYQYFVDGKKIGDIVPGESRSAYVNVAPKKDYFTFTVTALDKDGLVVKGKEVTLTDITDGKAVALASLKTNDNGQAIFTNLPLSRNISVSIDGKSKGYTLRTDVAGSHKAAAFYVDGKGTKAPQFSAEAAVVTVYDANGNTIANQEVTLTNSNGTIVAKGLTEKDGKARFANKLMAGTLYNIFVNGIEMPKTALVGSDVSVFLTDKQIKKEKPVTPDKLDKEMNQEKEKELLDTPKPVPPTSKPTAPIKNKKDDSPKKFTKSQSSSLKSSVKAIGAKPKAMTALAKKLPKTGDQAISILTLVGFIVTGLAIMLGFLKKSRSK

SEQ ID NO: 9331 - DNA, 1542 bp, Streptococcus agalactiae
atgacattacaagacgaaatcaaaaaacgccgtacttttgccatcatctctcacccggatgctggtaagacgactattactgagcaattattatattttggtggtgaaattagagaagcagggacagtaaaagggaaaaaatcaggtacttttgcaaagtccgactggatggatattgaaaagcaacggggtatctctgttacttcatctgttatgcaatttgattacgcgggtaaacgtgttaatattttggatacacctggacatgaggatttctcggaagatacataccggaccttaatggctgtggatgcagctgtcatggttgtagattcggctaaaggtattgaggctcaaactaaaaaactttttgaagttgttaagcatcgtaatattccggtttttacgtttattaataaattggaccgtgatggacgtgagccattggatttgcttgaagagttagaagaagtactaggtattgcttcttatccaatgaattggccgattggtatggggaaatcatttgaagggctttatgatttacataataaacgtttagaactctataagggagacgagcgttttgcaagtattgaagacggtgatcagctgtttgccaataatccattttatgaacaagtcaaagaagatattgaacttcttcaagaagcaggtaatgacttttcagaacaagctattcttgatggtgacctaactccagtattctttggctctgcccttacgaactttggagttcagacttttcttgatactttcttggagtttgctccagaacctcatggtcacaagactacagaaggtaatgttattgaccccttggctaaagatttttcaggttttgtctttaaaattcaagctaacatggacccacgtcatcgcgaccgtattgcttttgttcgtattgtttctggtgaatttgagcgcggtatgggagttaatttgacacgtactggtaaaggtgctaagctctccaatgttactcaatttatggcagaatcacgtgaaaatgtgacgaatgctgttgctggggatattatcggggtttatgatacaggaacttatcaagttggggataccttaacagttgggaaaaataaatttgaatttgaaccattaccaacttttaccccagaattatttatgaaagtatcagcaaaaaatgttatgaagcagaaatcattccacaaaggtattgagcaattagtacaagaaggagcaatccagctttataagaattatcagacaggcgaatacatgctgggtgctgtgggtcaacttcagtttgaagtttttaaacatcgtatggaaggtgaatacaatgctgaagttgttatgacaccaatgggtaaaaagactgtacgttggattaactcagacgatttagacgaacgcatgtcttcaagccgaaatattttagcaaaagatcgttttgaccaaccagttttcctatttgaaaatgattttgcacttcgctggtttgctgataagtatcctgatgtgaagcttgaagaaaaaatg

SEQ ID NO: 9332 - protein, 514 aa, Streptococcus agalactiae
MTLQDEIKKRRTFAIISHPDAGKTTITEQLLYFGGEIREAGTVKGKKSGTFAKSDWMDIEKQRGISVTSSVMQFDYAGKRVNILDTPGHEDFSEDTYRTLMAVDAAVMVVDSAKGIEAQTKKLFEVVKHRNIPVFTFINKLDRDGREPLDLLEELEEVLGIASYPMNWPIGMGKSFEGLYDLHNKRLELYKGDERFASIEDGDQLFANNPFYEQVKEDIELLQEAGNDFSEQAILDGDLTPVFFGSALTNFGVQTFLDTFLEFAPEPHGHKTTEGNVIDPLAKDFSGFVFKIQANMDPRHRDRIAFVRIVSGEFERGMGVNLTRTGKGAKLSNVTQFMAESRENVTNAVAGDIIGVYDTGTYQVGDTLTVGKNKFEFEPLPTFTPELFMKVSAKNVMKQKSFHKGIEQLVQEGAIQLYKNYQTGEYMLGAVGQLQFEVFKHRMEGEYNAEVVMTPMGKKTVRWINSDDLDERMSSSRNILAKDRFDQPVFLFENDFALRWFADKYPDVKLEEKM

SEQ ID NO: 9333 - DNA, 732 bp, Streptococcus agalactiae
atgataatagaattaaagagtgttggaaaaatttttccaaaatcacagtttagattagatgatatttcttttaatatagaagaaggcgagatagttggtctgattggttctaatggtactggaaagagtactattttgaagatgattaatggcttaatcccttatgataaaggaaatatttattatcaaggaaaagaagtgaagtctttttctgataataagttacgtcagatgcgtaaagatattgcttatatttttcaaaatcataatttgttagcaggagaaagtgtatattatcatctagctttagtttataaattaaatcatcaaaaagtaaatcatgacgcaattaatgatatcttagattttttaggtttgatggatttaaaacaggtgaaatgccatagtttgagtggtgggcagcaacaaaaagttgcaatcgctatggctgttttgcaaaaaccgaaacttattctatgtgatgagatcagctctgccttagatactaatagtgaaaaagagatatttaacttgttgtctgatcttcgtgaaaaatatggtatctctatcttgatgattgctcatcacctatctcttttaaaacaatattgtgatcgtgtaatgattttggatcaccagactattgtagatactgttgttccagtgaaagcaactctgaatcaattaaagtcaaactacgtagatcaagtaaaggagtttttgttacatgat

SEQ ID NO: 9334 - protein, 244 aa, Streptococcus agalactiae
MIIELKSVGKIFPKSQFRLDDISFNIEEGEIVGLIGSNGTGKSTILKMINGLIPYDKGNIYYQGKEVKSFSDNKLRQMRKDIAYIFQNHNLLAGESVYYHLALVYKLNHQKVNHDAINDILDFLGLMDLKQVKCHSLSGGQQQKVAIAMAVLQKPKLILCDEISSALDTNSEKEIFNLLSDLREKYGISILMIAHHLSLLKQYCDRVMILDHQTIVDTVVPVKATLNQLKSNYVDQVKEFLLHD

SEQ ID NO: 9335 - DNA, 606 bp, Streptococcus agalactiae
atggcaattattttaccagatttaccctatgcatatgatgcgcttgagccacatattgatgctgagacaatgacactacatcatgataagcaccatgcaacttatgttgctaatgcaaatgctgctcttgagaaacatcctgaaattggagaagacttagaggcgctcttagctgatgtttctcaaattccagaagatattcgtcaggcagtcatcaataacggtggtggacatcttaaccacgctcttttctgggaattgatgtcaccagaagaaactcaaatttcacaagagttatctgaagacattaatgcaacttttggttcatttgaagactttaaagctgctttcacagcagcagcaacaggacgttttggttcaggttgggcttggcttgttgttaatgctgaaggcaaacttgaagtgctttcaactgccaatcaagatactccaattatggaaggcaagaaacctattttagggcttgatgtatgggagcatgcttattacttaaactatcgtaatgttcgtcctaactacatcaaagctttctttgaaattattaactggaataaagtaaatgaactttaccaagctgctaaagct

SEQ ID NO: 9336 - protein, 202 aa, Streptococcus agalactiae
MAIILPDLPYAYDALEPHIDAETMTLHHDKHHATYVANANAALEKHPEIGEDLEALLADVSQIPEDIRQAVINNGGGHLNHALFWELMSPEETQISQELSEDINATFGSFEDFKAAFTAAATGRFGSGWAWLVVNAEGKLEVLSTANQDTPIMEGKKPILGLDVWEHAYYLNYRNVRPNYIKAFFEIINWNKVNELYQAAKA

SEQ ID NO: 9337 - DNA, 894 bp, Streptococcus agalactiae
ttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagataaaaatggtgtttcagatgtggtttcaacggttgattcaacaacttataaaacaagttactacatcattaaagtaactgataagacagagaaaaaatctgattggaaatcttacaaaaatcgcttaaaagaagttattcttaaggataaaacaagcgatagagccttccaaaataaagtgatttcaaaagccttagaaaaagctaatgttaagattaaagataaagcatttgcaggcatcttatcacaatatgctacaacaagtggttcatcatcacttaaaaaa

SEQ ID NO: 9338 - protein, 298 aa, Streptococcus agalactiae
MTLMSVATLAACSGKTSNGTNVVTMKGDTITVSDFYDQVKTSKAAQQSMLTLILSRVFDTQYGDKVSDKKVSEAYNKTAKGYGNSFSSALSQAGLTPEGYKQQIRTTMLVEYAVKEAAKKELTEANYKEAYKNYTPETSVQVIKLDAEDKAKSVLKDVKADGADFAKIAKEKTTATDKKVEYKFDSAGTTLPKEVMSAAFKLDKNGVSDVVSTVDSTTYKTSYYIIKVTDKTEKKSDWKSYKNRLKEVILKDKTSDRAFQNKVISKALEKANVKIKDKAFAGILSQYATTSGSSSLKK

SEQ ID NO: 9339 - DNA, 1038 bp, Streptococcus agalactiae
atggatttacaaaaacaattagaagagttgaaaatatcaactcaagaaaagcttaaagaaatgactgggaaccacactaaagaattacaagacttacgtgtacaagttttaggaaaaaaaggttctctaacagaattactaaaaggtctgaaagatttatctaatgatttacgaccagttgttggaaaacaagtcaatgaagtacgtgatattttaacaaaagcgtttgaggaacaagctaaagtagtggaagctgcgaagattcaagcacagttagagtctgagagtgtcgacgttaccttgcctggtcgtcaaatgacattaggtcaccgtcatgtcttaacacaaactagcgaagagattgaagatatctttttaggtatgggattccaagtggttgatggttttgaagttgagaaagactactataattttgaacgaatgaatttaccaaaagatcatccagcccgtgatatgcaagatactttttatattacagaagaaatcttgctacgtactcatacttcgcctgttcaagcacgaacaatggaccaacatgatttttctaaagggcctttaaaaatgatttctcctggacgtgttttccgtcgtgatactgatgatgctactcatagccatcaattccatcaaattgaaggcttagttgttggagaaaatatttcaatgggcgatctcaaaggaacacttcaactgatttctcaaaaaatgtttggagcagagcgtaaaatccgacttcgtccttcatatttcccattcacagaaccttcagttgaagttgatgtctcttgcttcaagtgcggaggtaagggatgtaatgtctgcaaacagacaggttggattgagatattgggtgctggtatggttcacccaagtgttttggaaatgtctggtattgattctgagaaatactccggttttgcctttggtttaggtcaagaacgtattgcaatgttacgctacggtatcaatgacattcgtggcttctatcaaggtgatgttcgcttcacagatcaattt

SEQ ID NO: 9340 - protein, 346 aa, Streptococcus agalactiae
MDLQKQLEELKISTQEKLKEMTGNHTKELQDLRVQVLGKKGSLTELLKGLKDLSNDLRPVVGKQVNEVRDILTKAFEEQAKVVEAAKIQAQLESESVDVTLPGRQMTLGHRHVLTQTSEEIEDIFLGMGFQVVDGFEVEKDYYNFERMNLPKDHPARDMQDTFYITEEILLRTHTSPVQARTMDQHDFSKGPLKMISPGRVFRRDTDDATHSHQFHQIEGLVVGENISMGDLKGTLQLISQKMFGAERKIRLRPSYFPFTEPSVEVDVSCFKCGGKGCNVCKQTGWIEILGAGMVHPSVLEMSGIDSEKYSGFAFGLGQERIAMLRYGINDIRGFYQGDVRFTDQF

SEQ ID NO: 9341 - DNA, 639 bp, Streptococcus agalactiae
atgtcttatattttagaaatcttacctagcttattagtaggtgcgcaagtgacattgcaagttttctttattgttatttgtttatcaattccacttggtattgttgtagccttcctaatgaaagttcattttaagccgcttcaatggctactgacaacttatatttggattatgcgaggcacgcctctgttattacagcttatctttttttattactttttaccaagtgtagggatttcttttgatcgtatgccagctgcgattattgcttttacgatgaattatgcagcttattttgcagagatttttcgaggaggtattgagtctattcctaaagggcaatatgaagctgcaaaggtattaaagttttctaagtttcaaacggtttggtacatagtattacctcaagtcttcaaaatagtcttaccgagtgttttcaatgaaacgattactttagtgaaagattcctcattggtttacatacttggtgtgggcgacttacttctagaaagtaagacagccgcaaatagggatgcaacacttgcaccaatgtttatagcaggtggtatttacctattattaattggtcttttaactattttatctaaacaagttgaaaagcgttttaactactataaa

SEQ ID NO: 9342 - protein, 213 aa, Streptococcus agalactiae
MSYILEILPSLLVGAQVTLQVFFIVICLSIPLGIVVAFLMKVHFKPLQWLLTTYIWIMRGTPLLLQLIFFYYFLPSVGISFDRMPAAIIAFTMNYAAYFAEIFRGGIESIPKGQYEAAKVLKFSKFQTVWYIVLPQVFKIVLPSVFNETITLVKDSSLVYILGVGDLLLESKTAANRDATLAPMFIAGGIYLLLIGLLTILSKQVEKRFNYYK

SEQ ID NO: 9343 - DNA, 858 bp, Streptococcus agalactiae
atgaaaaaaaacatttttttgttaaccttgctagccaccgtcttattgacgctgtctggttgtgctaattggattgataaaggtcaatcaatcaccagcgttggttcaaccgccttacagccacttgtagaagctgcagcagatgagtttggtaagacaaacctcggtaagactatcaatgtccaaggaggaggctcaggaacaggcttatcacaagtacagtctggagctgttcaaattggtaatagcgacttatttgcagaagaaaaagatggtattgatgctaagaaattgaaagaccatcaagtcgcagtagctggattagctgttattgttaataaaaaagttaatgttaaaaatctaaccacccaccaacttcgtgatatttttgcaggaaaaatcaagaattggaaagaagtgggaggacaagatttagatatttccatcatcaatcgagcagcaagttctggatcccgtgcaaccttcgataatactattatgggaaatgttgctcctattcaaagccaagaacaagattcaaatggtatggtgaaatcaattgtttctcaaacacctggtgcgatttcatacctcgcttttgcatacgttgataaatctgtcggaacattaaaactaaatggttttgcgccaacagctaaaaatgttactaccgacaactggaaactttggtcatatgaacatatgtatacaaaaggtaatgaaacaggtctaacaaaagaattcttagactacatgaaaagtgataaagttcaaagtagtatcgtacaacatatgggatatatctctattaacgacatgaaagttgttaaagatgctgaaggtaaagtaaccccaaaa

SEQ ID NO: 9344 - protein, 286 aa, Streptococcus agalactiae
MKKNIFLLTLLATVLLTLSGCANWIDKGQSITSVGSTALQPLVEAAADEFGKTNLGKTINVQGGGSGTGLSQVQSGAVQIGNSDLFAEEKDGIDAKKLKDHQVAVAGLAVIVNKKVNVKNLTTHQLRDIFAGKIKNWKEVGGQDLDISIINRAASSGSRATFDNTIMGNVAPIQSQEQDSNGMVKSIVSQTPGAISYLAFAYVDKSVGTLKLNGFAPTAKNVTTDNWKLWSYEHMYTKGNETGLTKEFLDYMKSDKVQSSIVQHMGYISINDMKVVKDAEGKVTPK

SEQ ID NO: 9345 - DNA, 1308 bp, Streptococcus agalactiae
atgaaattaccgaatgaatttattgaaaaatatcagactatacttaaagatgaagcagaagctttttttgacagttttgaacaaaaacccatatcggcatatcgcaccaatcctctcaaagaaaagcaacttgattttccaaatgccatcccaagtaccccttgggggcattatgggaaaatatcaggaaaatcaatagaacacacaactggccttgtttattctcaagaacctgctgctcagatagtggctcagattgctgaaccacaagaaggaatgaaagtgctagatttagcagctgcacctggtggaaaaacaacacaccttctatcatatttaaacaatactggtctattagttagtaatgaaatttcaaataaacgtagtaaaattttagtcgaaaatgtcgaacgttttggtgctagaaatgttatcgtgactaatgaaagctcccaacgactagccaaatgttttaattctttttttgatcttattgtttttgacggtccgtgttctggtgagggaatgttccgcaaagatcctcaagcaatacaatattggcacaaagattaccccactgaatgtgcacagttacaaagagatattttaaaagaagcaatcaaaatgctagctcatggtggtatacttgtatactctacttgtacatggtcaccagaagagaacgaagaagtggttaattggctccttcaagagtatgattacttagaacttgttgatattcctaaactaaatgggatggttgaagggattaatgtaccacaagttgcaaggatgtaccctcatcattttcaaggtgaaggacaattcgttgcaaaactgagagatactagatctaaggaagcacagaaaattaagccaaaagcacagaaaataaataaaatgcagttacaattgtggcaacaatttgcacaagaccatttaaagatagacttgaacggtgttttagatgttttcggcgaccaactctatcttctacctaatggtctccccgatttgtctaaattaaaaatagcacgcaatggtctccatctaggcactttcaagaagaatcgttttgagccatcgtttgctttaggaatggcacttagcgaacatgacctagtacagtctattgaaattgatatagaacagtttgaggtgtacgtatctggaaatgtagtcaaactagacaagactgttccaaacggttggtatcaaattcttgtaaaaggcaatggattaggttttgcaaaagtgacaaataatactcttaaaaattattaccctaaaggactacgatttcagaca

SEQ ID NO: 9346 - protein, 436 aa, Streptococcus agalactiae
MKLPNEFIEKYQTILKDEAEAFFDSFEQKPISAYRTNPLKEKQLDFPNAIPSTPWGHYGKISGKSIEHTTGLVYSQEPAAQIVAQIAEPQEGMKVLDLAAAPGGKTTHLLSYLNNTGLLVSNEISNKRSKILVENVERFGARNVIVTNESSQRLAKCFNSFFDLIVFDGPCSGEGMFRKDPQAIQYWHKDYPTECAQLQRDILKEAIKMLAHGGILVYSTCTWSPEENEEVVNWLLQEYDYLELVDIPKLNGMVEGINVPQVARMYPHHFQGEGQFVAKLRDTRSKEAQKIKPKAQKINKMQLQLWQQFAQDHLKIDLNGVLDVFGDQLYLLPNGLPDLSKLKIARNGLHLGTFKKNRFEPSFALGMALSEHDLVQSIEIDIEQFEVYVSGNVVKLDKTVPNGWYQILVKGNGLGFAKVTNNTLKNYYPKGLRFQT

SEQ ID NO: 9347 - DNA, 876 bp, Streptococcus agalactiae
atgagagagtctatttttgaggaaactgcaaaaggtaaagtatcaaggcatgtccttttaactatattattggctttgatattactatttacagcagatttccttacctatattattattgaattgattatctcgcttgatttttggaaactagagtgggatagcgatatcgtccagttaatcattttactagcaacttcaattagtacggtaatgttatttatgtgggtgaaatttaaagagaagcgtccaattagttctctagggctatttaaagaaggagccctaacagaattatctagaggatggttagtcgggagcgttctctttggagcctgcttaatattaacaataatttcaggctctggagttatcgaaactgttcgttttacagctgataaattgatttggtttcttatttttgctgttggatggcaggtacaaagcgcatctgttgaaatattgtgtcgtggatggttacttccggtgagtgccacaaagtatagtaagatagtttctgtcagtatcagttcaatctttttcggtcttctgcatagcgctaataatcatgtaagccttatctcgattttcaatctgtgtctctttggactatttctatcgctctatgttattttaaaaggtaacatctggggggcgtgtggtattcatggcgcctggaactgtgtacaagggagtgtctttggaatcgaagttagtggagagccaatgttgtctaactccctagtccatgttaaaacctatggtgctgactggattagcggtggaaaatttggtgtggaaggaagcatgattaccagtattgttcttatcgtagcatgttattggctttatcaaaaatcgaattttccttacgac

SEQ ID NO: 9348 - protein, 292 aa, Streptococcus agalactiae
MRESIFEETAKGKVSRHVLLTILLALILLFTADFLTYIIIELIISLDFWKLEWDSDIVQLIILLATSISTVMLFMWVKFKEKRPISSLGLFKEGALTELSRGWLVGSVLFGACLILTIISGSGVIETVRFTADKLIWFLIFAVGWQVQSASVEILCRGWLLPVSATKYSKIVSVSISSIFFGLLHSANNHVSLISIFNLCLFGLFLSLYVILKGNIWGACGIHGAWNCVQGSVFGIEVSGEPMLSNSLVHVKTYGADWISGGKFGVEGSMITSIVLIVACYWLYQKSNFPYD

SEQ ID NO: 9349 - DNA, 2628 bp, Streptococcus agalactiae
atgggaaagacattttggaaagatatctatcgatcaattacgacttcaaaaggtagattttcatcaatcctcttacttatgatgttaggctcatttgcttttataggactgaaggtctcagcacctaatatgcaaagaacagcacaaaattaccttgctcatcatcatgttatggatattaccgttttcaattcttggggacttgacaaacatgatcaaactgttttagaaagcttaaaaggatcacaagttgaattttcttactttgtagatacaacccctcaacagaatagtaaatcttatcgattgtattccaataccaaaacgatatcaacctttgatcttgttaagggacgtctccctttaaataaatcagaaattgctctctcatttcaggaacgaaaaaaatatgcaataggtgataaaattaattttaaacaagataaaaacaaactgttttcaaatacaggtcctctaactattgtaggttttgttaattctaccgagatttggtctaagacaaaccttggtagttctcaaacaggggacggcgacttagatagttatggcgtattagataagacagcatttcactctccagtatatacaatggcaagggtaacttttaaagatcttaggttgattaaccctttctcaataagttacaaagaaaaagtagcgaaataccaagaaaaggtatcgcgaaaattaaatattcacaataaaataagatataccaaaacaaaaaaagagagcctacgtaaaatcgatgaggaggaaaaaagcctactaaaagctcaaaaacaaatcaatcggttagataatgatagcctagcgatgccactatctcaaagacaagctattcaaatgaaaattaaacaagaccgactatctcttttgaaacgaacaaaagagcttctaaaattgagacataacacccaaataatggaatcgcctcaaattattgtctacaaccgtactacctttcctggaggacaaggatataacacttttgactccagtacaaatagcacttctaaaatcagtaatcttttccccattattttatatttagtcgcagcattagtaaccttaacaacaatgactaggttcgtcgaggaagaaagaaccaacgcaggcatattaaaagcactaggctatagtgaccgccaagttatctttaaatttattatttatggttttatagcaggaacattagggactactttgggtatcattggagggcattatcttttacctcgtattatttctgatatcatttccaaagacctgactattccaaacacacagtatcatcttttcttaaattacagtttactagcctttgttttttcattattaagcattgttcttccagtttttgttatcactcgacgtgagttgaaagaaaaagcagcatttttattattaccaaaaccaccagctaaaggatctaaaatagctttagagtatatcaattggatttggaaaaaactgtccttcacacaaaaagtaactgctagaaatatttttcgttacaaacaaaggatgattatgaccatatttggagttgctggatcagtagcgctcttattttcaggtctaggaatacaatcctccttaaagcaaaccgtcaatgaacatttcggtcgtattatgccctatgatatattgctaacatataacacaaatgcttctcccccaaaaatacttgaactactttcaaaagattcaaaaatagacaaataccaaccaatacaccttgaaaatcttgacgaatccattcctggacaaattaataaacagtcaatttccctattcataacagacaaaaaacaattactaccttttatttatttacaagaagcaacaactaataagtcattgcacttgaataataaagggattattatttctaaaaaattagctcaattttatcatgttaataccggtgattttatccatttatctcattcacaaacacttccttctagaaaattaaaaataacaggagttgtcaatgcgaatgttggtcactatatttttatgacaaaacaatactatcgaactatttttaagaaagaagctaaagataacgcttttttggttaagttaaccaaacataaaatcgcaaataacttagcagaaaaacttttagaaattaatggagttgagtctcttacgcaaaatgctcttcagctggctagtgtagaagccgttgtgcgttctttagatggctctatgactattttagttgtcgtatctttattgttagccattgtaattctctataatctcactaatattaatttagcagaacgtaagcgggagctatcaactataaaggtattaggtttttataatgaagaagtaactttatacatttaccgcgaaaccattattttatcaaccatcggtgtgattctaggcaccattagcggtacttatttacaccgtcaaatgatgttgctaattggttcagatcaaatactttttggtgaaaaagtatcaccaactacatttataataccaataagcgtagtagtcatcattctaataagtctaggttttatagttaaccatcaattaaaaaaactcaatatgttagatgccttgaaatcagtagat

SEQ ID NO: 9350 - protein, 876 aa, Streptococcus agalactiae
MGKTFWKDIYRSITTSKGRFSSILLLMMLGSFAFIGLKVSAPNMQRTAQNYLAHHHVMDITVFNSWGLDKHDQTVLESLKGSQVEFSYFVDTTPQQNSKSYRLYSNTKTISTFDLVKGRLPLNKSEIALSFQERKKYAIGDKINFKQDKNKLFSNTGPLTIVGFVNSTEIWSKTNLGSSQTGDGDLDSYGVLDKTAFHSPVYTMARVTFKDLRLINPFSISYKEKVAKYQEKVSRKLNIHNKIRYTKTKKESLRKIDEEEKSLLKAQKQINRLDNDSLAMPLSQRQAIQMKIKQDRLSLLKRTKELLKLRHNTQIMESPQIIVYNRTTFPGGQGYNTFDSSTNSTSKISNLFPIILYLVAALVTLTTMTRFVEEERTNAGILKALGYSDRQVIFKFIIYGFIAGTLGTTLGIIGGHYLLPRIISDIISKDLTIPNTQYHLFLNYSLLAFVFSLLSIVLPVFVITRRELKEKAAFLLLPKPPAKGSKIALEYINWIWKKLSFTQKVTARNIFRYKQRMIMTIFGVAGSVALLFSGLGIQSSLKQTVNEHFGRIMPYDILLTYNTNASPPKILELLSKDSKIDKYQPIHLENLDESIPGQINKQSISLFITDKKQLLPFIYLQEATTNKSLHLNNKGIIISKKLAQFYHVNTGDFIHLSHSQTLPSRKLKITGVVNANVGHYIFMTKQYYRTIFKKEAKDNAFLVKLTKHKIANNLAEKLLEINGVESLTQNALQLASVEAVVRSLDGSMTILVVVSLLLAIVILYNLTNINLAERKRELSTIKVLGFYNEEVTLYIYRETIILSTIGVILGTISGTYLHRQMMLLIGSDQILFGEKVSPTTFIIPISVVVIILISLGFIVNHQLKKLNMLDALKSVD

SEQ ID NO: 9351 - DNA, 315 bp, Streptococcus agalactiae
atgtggcaggcacttacccttggggccaaagaacttggctaccagtttggaccatttatgggtaatggtggcgattggaaaaataagccgggctatcaaaccacacacgaggcaaaaacaggctacgccatctcatttagccccggccaagctggtgctgatagaacttacggccacgtggccatcgtcgaagacgttaaggaagacggatctatcccgatctccgaatcaaatgtcctaggacttggcaccatctcctaccgcaccttcagtgcagcagaagcagcacaattgacttatgtagttggggagaag

SEQ ID NO: 9352 - protein, 105 aa, Streptococcus agalactiae
MWQALTLGAKELGYQFGPFMGNGGDWKNKPGYQTTHEAKTGYAISFSPGQAGADRTYGHVAIVEDVKEDGSIPISESNVLGLGTISYRTFSAAEAAQLTYVVGEK

SEQ ID NO: 9353 - DNA, 1539 bp, Streptococcus agalactiae
atgagtattttagaagtaaaaaacttaagtcacggttttggtgatcgtgctatttttgagaatgtttcttttcgccttttaaaaggtgaacatataggacttattggtgctaatggtgaaggaaaatcaacattcatgtcaattgtcacaggtcatcttcaacctgatgaaggaaaaattgaatggtcaaaatatgtaactgctggttaccttgatcaacatactgtattagaagaaggtcaaacagttcgtgatgttttgcgaacagcatttgatgaactttttaaaacagaggcacgtatcaatgatatatatatatccatggcagatgatggcgcagatgtagatagccttatggaagaagttggagaactacaagatcgtttagaatcacgtgatttttatacacttgatgctaaaattgatgaagttgcacgggcattaggagttatggattttggtatggattctgatgttactgaattatctggtggtcaaaggacaaaggttcttttagcaaaactgttattagaaaagccagacatcctcctgcttgatgagcctacaaactaccttgatgctgaacacattgattggttaaaacgctatttacaaaattatgaaaatgcttttgttttaatctcacacgatattccatttttgaacgatgttatcaatattgtctatcatgttgaaaatcaagatttagtaagatattccggtgattatactaattttgaatcagtctatgcaatgaaaaaggctcaattagaagcagcctatgaacgtcaacaaaaggaaatagctgatttacaagattttgttaatcgtaataaagcacgcgtcgcaacacgtaatatggcaatgtctcgtcaaaagaaactagacaaaatggatattattgagttacaagcagagaaaccaaagccaagtttcgaatttaaagaatctcgcacaccaggacgttttattttccaagctaaagatcttcaaattggatatgatcgtgctttaacaaaacctctaaacctaacatttgaacgtaatcaaaaaatagctattgttggagcaaatgggataggaaaaacaacattacttaagagtttactaggtattatcccccctatttctggtaatgttgaacgaggtgattttattgatttaggttattttgaacaagaagtacccggaggaaatcgccaaactccactcgaagcagtatgggatgcttttcctgctttgaaccaagcagaggttagggcagctcttgctcgttgtggtttaacttcaaagcatattgaaagtcagattcaggtgttatctggtggggagcaatcaaaggtcagattttgcttattaatgaatcgcgaaaataatgtccttgtacttgacgaaccaaccaatcatttagatgtagatgctaaagatgagttaaaacgtgctttaaaagcttataagggatcaatcttgatggtatgtcatgaaccggacttttatgaaggatggatggatgatgtttgggactttaaccaacttagt

SEQ ID NO: 9354 - protein, 513 aa, Streptococcus agalactiae
MSILEVKNLSHGFGDRAIFENVSFRLLKGEHIGLIGANGEGKSTFMSIVTGHLQPDEGKIEWSKYVTAGYLDQHTVLEEGQTVRDVLRTAFDELFKTEARINDIYISMADDGADVDSLMEEVGELQDRLESRDFYTLDAKIDEVARALGVMDFGMDSDVTELSGGQRTKVLLAKLLLEKPDILLLDEPTNYLDAEHIDWLKRYLQNYENAFVLISHDIPFLNDVINIVYHVENQDLVRYSGDYTNFESVYAMKKAQLEAAYERQQKEIADLQDFVNRNKARVATRNMAMSRQKKLDKMDIIELQAEKPKPSFEFKESRTPGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 9355 - DNA, 1716 bp, Streptococcus agalactiae
atgacttacacagaaaatcttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaagggagaggaagctaaaaaacgtggtgtagccattgcctatgattcacgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcgggccttattcaggttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttacggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggttattttgctgaaaaaacgatttcagtaacactttcaggtgtggatggagctgctgaaattaagaagattatggacaaattccgtgaaaatggtccaaaacaatttaacaatactgacattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacggtcggtaatgatttagcagatgcagaaacaaaaatcgccaatattgaaaaagagattacaacatttgtaaat

SEQ ID NO: 9356 - protein, 572 aa, Streptococcus agalactiae
MTYTENLQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDESKSSGLIQVIGEDVDIEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATVGNDLADAETKIANIEKEITTFVN

SEQ ID NO: 9357 - DNA, 648 bp, Streptococcus agalactiae
atggataaattaaaatgccttggagaaaagttttcagagggtcacttttatccacttcaactggatattacaagtagagaatcggttgacaaagctttagaaagtctgcctaaaaaattgcaatcaattgatttgttggttaataatgcaggtttagcacttggattggataaatcatatgaagctgattttggagattggatgactatgattaatactaacgttgtaggattaatttacttgacacgatgcattttacctaaaatggtagaagttaatagagggttaattatcaatttgggatcaactgcaggaacaattccttatccaggagctaatgtctatggcgcatcaaaagcttttgtaaaacaattttctctcaacttgcgtgccgatttagctggaactaaaatcagagtgactaacctagaacccggtttatgtgaagggacagaattttcaactgtacgtttcaaaggggatcataaaagagttgaaaaactttatgaaggtgcgcatgcaattcaagcagaggatattgctaataccgtgtcatgggttgctagccaaccagaacacattaatattaatcgcatagaaataatgccagtcagtcaaacttatggacctcaacctgtttatcgtgat

SEQ ID NO: 9358 - protein, 216 aa, Streptococcus agalactiae
MDKLKCLGEKFSEGHFYPLQLDITSRESVDKALESLPKKLQSIDLLVNNAGLALGLDKSYEADFGDWMTMINTNVVGLIYLTRCILPKMVEVNRGLIINLGSTAGTIPYPGANVYGASKAFVKQFSLNLRADLAGTKIRVTNLEPGLCEGTEFSTVRFKGDHKRVEKLYEGAHAIQAEDIANTVSWVASQPEHININRIEIMPVSQTYGPQPVYRD

SEQ ID NO: 9359 - DNA, 990 bp, Streptococcus agalactiae
atgcgttccttatttggtggtttaagagaaaaagttgcaagtgattatgttaagattgttttccctgagggaagcgatgaacgtgtattacgtgcagcagctcgtttgaaatttgaaggtcttgttgatcctgttattttaggtaaggctgacgaagttcacgattctttggcaagacttggttttgttgatcaagattatagcattattgaccctgaacaatacgaaaaatttgaagagatgaaagaagcttttgttgagattcgtaaaggcaaagctactatggaagatgcagatcgtcttttgaaggatgttaactattttggggttatgttagtaaaacttggtttggcagatggtatggtatcaggggccattcattcaacagctgatactgtacgtcctgctcttcaaattattaaaacaaaaccaggaatttcacgcacttcaggtgtattcttgatgaaccgtgaaaatacacaggaacgttatatttttgctgactgtgctattaacattgatcctaatgcacaagagctagcagaaattgcagtaaatactgcggatacagctaaaatatttgatattgatcccaagattgctatgcttagtttttcaacaaaaggaagtgcaaaagcgcctcaagctgaaaaagttcaagaagcagctaaaattgccaaagatttatctcccgaattagctgttgatggagaattacaatttgatgcagcttttgttccggaaactgcagaaattaaagctcctaatagtgatgttgctggaaaagcaaatgtttttattttcccagaccttcaatcaggaaatattggctataaaattgcacaacgtttgggtatgtttgaagcaatcggaccgattttacaaggattgaatgctccagtaaatgatttatcacgtggatcaagtgctgaagatatttataaacttgctatcattacagctgctcaagctattgatgagaaatcaaaa

SEQ ID NO: 9360 - protein, 330 aa, Streptococcus agalactiae
MRSLFGGLREKVASDYVKIVFPEGSDERVLRAAARLKFEGLVDPVILGKADEVHDSLARLGFVDQDYSIIDPEQYEKFEEMKEAFVEIRKGKATMEDADRLLKDVNYFGVMLVKLGLADGMVSGAIHSTADTVRPALQIIKTKPGISRTSGVFLMNRENTQERYIFADCAINIDPNAQELAEIAVNTADTAKIFDIDPKIAMLSFSTKGSAKAPQAEKVQEAAKIAKDLSPELAVDGELQFDAAFVPETAEIKAPNSDVAGKANVFIFPDLQSGNIGYKIAQRLGMFEAIGPILQGLNAPVNDLSRGSSAEDIYKLAIITAAQAIDEKSK

SEQ ID NO: 9361 - DNA, 549 bp, Streptococcus agalactiae
atggaaaatcaaaaacaagatattaaaacttcagtaacttatgaagaaaaggtaattgctaaaattgttggacatgctttagaatcagtagacggactcttagctgtgagtggaggtttcttctctaatctaaaaaatagcgttgtaaattctgactcagtaactgatggtgtaaatgttgaagttggtactaaagaagttgcagttgatttagacatcgttgttgaatacggcaaggacatcccagctatcgttgaaagcattaaagcgattgtcagtcaaaacgttgaagtgatgacccaccttaaagttgttgaattgaacgcaaatgtcgtagatattaagactaaagctgaacatgaagctgactcagtgacagtacaagatcgtgtatctgatgcagcacaagcaacaggaaactttgcttctgaacaagctggcaaagctaaagcagcaatttcctctggagcagagaaaacaaaagaagcagtatcaaatggtactgaggctgcaaaagaaaaaatctcagaagctcgtactagtgaatct

SEQ ID NO: 9362 - protein, 183 aa, Streptococcus agalactiae
MENQKQDIKTSVTYEEKVIAKIVGHALESVDGLLAVSGGFFSNLKNSVVNSDSVTDGVNVEVGTKEVAVDLDIVVEYGKDIPAIVESIKAIVSQNVEVMTHLKVVELNANVVDIKTKAEHEADSVTVQDRVSDAAQATGNFASEQAGKAKAAISSGAEKTKEAVSNGTEAAKEKISEARTSES

SEQ ID NO: 9363 - DNA, 1398 bp, Streptococcus agalactiae
ttggggtatagccaagcggtaaggcaagggactttgactccctcatgcgttggttcgaatccagctaccccagtcaaaggtatcaaacttttgtttgacaccgtcaaagagatatttgttgtccttgcgggttaccttgagaaaatatattgttatcaaaagctagctcggctagcttttgttggaggattttttagaatgaatgaatttgaagatttgctaaacagtgttagcgaagtgaatcctggtgacgttgtcactgcggaagttttaacagttgataacggtcaagcaaacgttgttatcgatggtactggtgttgaaggtgtcttgacacttcgtgaattgactaacgatcgtgatgctgatatcaatgattttgttaaagctggcgacacagttgaagtacttgttcttcgtcaagttgtaggtaaagatactgatacagtaactttccttgtatctaaaaaacgcttggaagctcgtaaagcatgggacaaacttgttggtcgtgaaggtgaagttgttactgttaaaggtacacgtgctgttaaaggcggactttcagttgaatttgaaggacttcgtggtttcatcccagcttcaatgattgatactcgttttgtacgtaatactgaaaaatttgttggacaagaatttgatgctaaaatcaaagaagttgatgcagcagaaaatcgcttcatcctttcacgtcgtgaagttgttgaagaatcagcagctgcagcacgtaaagaagttttctcaaacattgaagtaggttcagttgtaactggtaaagttgctcgtttaacaagctttggtgctttcattgaccttggtggtgttgatggacttgtacacgtaactgaattatcacatgagcgcaatgtttcacctaaatcagttgtaactgttggtgaagaagttgaagttaaagtactttcaattgatgaagaagctggtcgtgtatcactttcacttaaagcaactacacctggcccatgggatggcgttgaacaaaaacttgctgctggtgatgttattgaaggtaaagtaaaacgcttgactgactttggtgcttttgttgaagtgttacctggcattgatggacttgtacacatttcacaaatttcacacaaacgtgttgaaaatcctaaagacgtattatctgcaggacaagaagttactgttaaagttcttgaagttaattcagatgcagaacgtgtctcactttcaatgaaagctcttgaagagcgtccagcgcaagcagaaggtgaaaaagaagaaaaacgtcaatcacgtccacgtcgtccacgtcgtcaagaaaaacgcgactacgagcttccagaaacacaaactggattctctatggctgacttattcggtgatattgaatta

SEQ ID NO: 9364 - protein, 466 aa, Streptococcus agalactiae
MGYSQAVRQGTLTPSCVGSNPATPVKGIKLLFDTVKEIFVVLAGYLEKIYCYQKLARLAFVGGFFRMNEFEDLLNSVSEVNPGDVVTAEVLTVDNGQANVVIDGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVVEESAAAARKEVFSNIEVGSVVTGKVARLTSFGAFIDLGGVDGLVHVTELSHERNVSPKSVVTVGEEVEVKVLSIDEEAGRVSLSLKATTPGPWDGVEQKLAAGDVIEGKVKRLTDFGAFVEVLPGIDGLVHISQISHKRVENPKDVLSAGQEVTVKVLEVNSDAERVSLSMKALEERPAQAEGEKEEKRQSRPRRPRRQEKRDYELPETQTGFSMADLFGDIEL

SEQ ID NO: 9365 - DNA, 228 bp, Streptococcus agalactiae
gtgagtaaaaaagataagaaaattgaaattcaaatttcagacgctcaagtaacagttaatggaactaaggttgatggataccaactcgttattggaaaaaaaattgtaggtcaaattgcagagctagattctaaatttgctgtgattaaaggtgagcaagtgagtggattctataaaaatttagatcaagctatgggaaatattattgaagaatataatcttaatcgc

SEQ ID NO: 9366 - protein, 76 aa, Streptococcus agalactiae
MSKKDKKIEIQISDAQVTVNGTKVDGYQLVIGKKIVGQIAELDSKFAVIKGEQVSGFYKNLDQAMGNIIEEYNLNR

SEQ ID NO: 9367 - DNA, 1044 bp, Streptococcus agalactiae
atgactgaatttaaaaacattatcgtaactggtggagctggtttcatcggatcaaactttgtacactatgtttacaataaccacccagatgttcatgtaactgtccttgataaattgacatatgcaggtaaccgtgctaacattgaagccattcttggtgatcgtgttgagttagttgttggtgacatcgctgacgctgaattggtagacaagttggctgccaaagcagatgctattgttcactatgcggctgagagccacaatgacaactcacttaacgatccaagtccatttatccatacaaactttatcggaacttacactttgcttgaagcagctcgtaaatacgatatccgtttccaccacgtgtcaactgatgaagtttatggagatctgccacttcgtgaagaccttccaggaaatggtgaaggaccaggtgaaaaattcactgctgaaacaaaatacaatccatcatcaccttactcatcaactaaggcagcttctgaccttatcgttaaggcatgggtacgttccttcggcgtaaaagcgaccatttcgaactgttcaaataactatggaccataccaacacatcgaaaaattcattccacgtcaaattacaaatatcttggcaggaatcaaaccgaaactttatggtgaaggtaaaaacgtccgtgactggatccacacaaatgatcattcaacaggtgtctgggctattttgactaagggtcgtattggtgaaacataccttattggtgccgacggtgagaaaaacaacaaggaagttcttgaacttatccttgagaaaatgggtcaaccaaaagacgcttacgatcacgtaactgaccgtgctggacacgaccttcgttacgctatcgattctacaaaattgcgtgaagaacttggttgggaaccacaattcacaaacttctcagaaggtttggaagaaacaatcaactggtacactgaaaaccaagattggtggaaagcagagaaagaagcagttgaagctaactacgctaaaacgcaagaagtcattaac

SEQ ID NO: 9368 - protein, 348 aa, Streptococcus agalactiae
MTEFKNIIVTGGAGFIGSNFVHYVYNNHPDVHVTVLDKLTYAGNRANIEAILGDRVELVVGDIADAELVDKLAAKADAIVHYAAESHNDNSLNDPSPFIHTNFIGTYTLLEAARKYDIRFHHVSTDEVYGDLPLREDLPGNGEGPGEKFTAETKYNPSSPYSSTKAASDLIVKAWVRSFGVKATISNCSNNYGPYQHIEKFIPRQITNILAGIKPKLYGEGKNVRDWIHTNDHSTGVWAILTKGRIGETYLIGADGEKNNKEVLELILEKMGQPKDAYDHVTDRAGHDLRYAIDSTKLREELGWEPQFTNFSEGLEETINWYTENQDWWKAEKEAVEANYAKTQEVIN

SEQ ID NO: 9369 - DNA, 1779 bp, Streptococcus agalactiae
atgaatgaactgattaaacataagctagaattgttaccagacagtcctggttgttaccttcataaagataagaatgggacaattatttatgtaggtaaggctaaaaatcttaagaatcgtgtgaaaagttattttcatgggagtcataatactaagacagaacttttggtctctgagattgaagactttgaatacattgtgacaacatctaataccgaagctctattattggaaattaatttaatccaagaaaatatgccgaagtataatattcgattgaaagatgataagtcttacccatatatcaaaataacaaatgaacgttatcctcgtcttatgattacacgtcaagtaaaaaaatcagatggcacttattttggaccttatccggattctggggcagcaactgagattaagcggttactagataggctctttccttttaagaaatgtactaatccagcaaataaagtatgcttttattatcatttagggcaatgcaatgcacatacagtttgtcaaactaataaagcttattgggatagtctgagagaagatgtaaaacagtttcttaatggtaaagataataaaattgttaacggattaactgaaaaaatgaagagcgctgctatgactatggaatttgagcgtgcggctgaatatcgagatttgatcgaagcaattagtttgttgcgtactaagcagcgtgttattcatcaagatatgaaggatagagatgtttttggttatttcgttgataagggttggatgtgtgtacaggtcttttttgttcgaaatggaaaattgattcagcgtgacgtgaatatgtttccttattataatgaaccagaggaagattttctaacttacatagggcaattttatcaagatacaaaacattttctacccaaagaagtctttattccacaggatattgatgctaagtcggttgaaacaattgtaggctgtaagattgttaaaccacaacgtggtgaaaagaaacagttagtaaatctggcaataaaaaatgctcgtgtcagtttacaacagaagtttgacttactggaaaaagatattcgtaaaactcatggggcaattgaaaatttaggtaatcttcttaatatccctaaaccagtacgcatagaagcatttgataattccaatattcaagggacaagtccagtagctgctatggtggtatttgtgaatggaaagccaagtaaaaaagactatcgaaagtttaaaattaagactgttatcggaccagatgattatgctagtatgagagaagtcattcatcggcgttatagtagggttttaaaagatggcttgacacctccggacttgattgtaattgatggtggtcaggggcaagtaaatatagcgcgtgatgttattgagaaccaatttggtttagccatacctattgcaggtttgcaaaagaatgataaacaccaaacacatgaattactttttggagatcctttagaagtagtagagctaccgcgtaattcagaagaatttttcttacttcaccgtattcaagatgaggtacatcgttttgctattacttttcatcgtcaattacgctccaaaaattccttttcttcaaaattagatggtatcactgggttgggaccaaaacgtaaacaattgctaatgaaacattttaaaagcttacctaatatccaaaaagctgagattgaggacattattatgtgtggtattcctaggactgttgcagaaagtctccgagattctcttaatgatcctcctaaa

SEQ ID NO: 9370 - protein, 593 aa, Streptococcus agalactiae
MNELIKHKLELLPDSPGCYLHKDKNGTIIYVGKAKNLKNRVKSYFHGSHNTKTELLVSEIEDFEYIVTTSNTEALLLEINLIQENMPKYNIRLKDDKSYPYIKITNERYPRLMITRQVKKSDGTYFGPYPDSGAATEIKRLLDRLFPFKKCTNPANKVCFYYHLGQCNAHTVCQTNKAYWDSLREDVKQFLNGKDNKIVNGLTEKMKSAAMTMEFERAAEYRDLIEAISLLRTKQRVIHQDMKDRDVFGYFVDKGWMCVQVFFVRNGKLIQRDVNMFPYYNEPEEDFLTYIGQFYQDTKHFLPKEVFIPQDIDAKSVETIVGCKIVKPQRGEKKQLVNLAIKNARVSLQQKFDLLEKDIRKTHGAIENLGNLLNIPKPVRIEAFDNSNIQGTSPVAAMVVFVNGKPSKKDYRKFKIKTVIGPDDYASMREVIHRRYSRVLKDGLTPPDLIVIDGGQGQVNIARDVIENQFGLAIPIAGLQKNDKHQTHELLFGDPLEVVELPRNSEEFFLLHRIQDEVHRFAITFHRQLRSKNSFSSKLDGITGLGPKRKQLLMKHFKSLPNIQKAEIEDIIMCGIPRTVAESLRDSLNDPPK

SEQ ID NO: 9371 - DNA, 1338 bp, Streptococcus agalactiae
atgtatcaaactcagacaaataaggaaaaatttgttttatttttgaaattatttatcccagtattgatttatcaatttgctaatttttcagctacttttattgattcggttatgactggacagtatagtcagctacatttggcaggtgtgtcaactgctagtaatttatggactccgtttttcgctttattagtaggtatgatttcagcattagtaccagtagttggtcaacatttgggtagaggaaataaagaacaaattcgcacagaatttcatcaatttctatatttaggtttgatactgtccttaatattatttttaatcatgcaatttattgctcaacctgtcttggggagtttgggtttagaagatgaagttctagcagttggtcgtggttatttaaattatatgttgattggaatcatgccgctggtgttgtttagcatttgccgttcattctttgatgcattggggttaacaaggttatctatgtatctgatgcttttaattctaccctttaattcattttttaattatatgcttatctacggtaaatttggtatgcctagactaggaggtgcgggggcaggtcttggaacttctttaacttattgggctatttttattgttattattattgtgatgtcacttcatcctcaaattaaaacatatcatatatggactctggaaagaataaaagctcctttgattattgaagatattcgattgggattaccgattggtttacaaatttttgcagaagttgcaatttttgcagtagtaggcttattcatggcaaaattttcttcaatcattattgcagcacatcaggctgctatgaatttttcatcattaatgtatgcctttcctttaagtatttccactgctctagctattacaatatcgtttgaagtaggggcagagcgctttcaggacgcaaacacttatagtaggataggacgcttaacagcggtagggattacatcaggaaccttactatttttatttctatttcgtgagaatgtagcagcaatgtataatagtgaccctcactttgtcgctattacagctcaattcctaacttatagtctctttttccagtttgcagatgcttatgcagctcctgtacaggggattttacgaggctataaggatacaacaaaaccatttatgatcggtgcgggctcttattggttatgtgctttgccattagcggttatcttagaaaaaaatagccagttaggtccttttgcctattggattggtttaatcacaggtatttttgtttgtggtctatttctaaaccaacgtctgcaaaagattaagaagttgtattat

SEQ ID NO: 9372 - protein, 446 aa, Streptococcus agalactiae
MYQTQTNKEKFVLFLKLFIPVLIYQFANFSATFIDSVMTGQYSQLHLAGVSTASNLWTPFFALLVGMISALVPVVGQHLGRGNKEQIRTEFHQFLYLGLILSLILFLIMQFIAQPVLGSLGLEDEVLAVGRGYLNYMLIGIMPLVLFSICRSFFDALGLTRLSMYLMLLILPFNSFFNYMLIYGKFGMPRLGGAGAGLGTSLTYWAIFIVIIIVMSLHPQIKTYHIWTLERIKAPLIIEDIRLGLPIGLQIFAEVAIFAVVGLFMAKFSSIIIAAHQAAMNFSSLMYAFPLSISTALAITISFEVGAERFQDANTYSRIGRLTAVGITSGTLLFLFLFRENVAAMYNSDPHFVAITAQFLTYSLFFQFADAYAAPVQGILRGYKDTTKPFMIGAGSYWLCALPLAVILEKNSQLGPFAYWIGLITGIFVCGLFLNQRLQKIKKLYY

SEQ ID NO: 9373 - DNA, 297 bp, Streptococcus agalactiae
atgacccaaacactagaagaaatgcgttataaacttgaagaatggttggcacaaggctatacaagtccagaagatagggcaaactaccaaactttaaaggaacagtatgaagatgagacctttgattacagtttttcaaagcgtgaaattactggacagctggaactcatcatcaaaagtcgtgagaatgatttttcaaacttagatgaggtgacgaagacggaataccttgacttggttacccaacttgatgaacttgaccaggaacaagccaactattatcgtaagcaattagcc

SEQ ID NO: 9374 - protein, 99 aa, Streptococcus agalactiae
MTQTLEEMRYKLEEWLAQGYTSPEDRANYQTLKEQYEDETFDYSFSKREITGQLELIIKSRENDFSNLDEVTKTEYLDLVTQLDELDQEQANYYRKQLA

SEQ ID NO: 9375 - DNA, 171 bp, Streptococcus agalactiae
atgcaaaaggaagaacagtcatcacgtcatatcgtgaagagccatatcatgaccatcatgggagttgataatctaaaagcaactcaactggtaaatgaaatggaacaaacaggtttaatccgatttgatgaattcgggaattttggacttttagtcttggagggacaatca

SEQ ID NO: 9376 - protein, 57 aa, Streptococcus agalactiae
MQKEEQSSRHIVKSHIMTIMGVDNLKATQLVNEMEQTGLIRFDEFGNFGLLVLEGQS

SEQ ID NO: 9377 - DNA, 1374 bp, Streptococcus agalactiae
atggaaaatcatcgttatgaagatgaaggtaaattccagcgtaagatgaccagtcgtcatctctttatgttatcgctaggtggtgttatcgggactgggcttttcttgagttcaggttataccattgcacaggctggtccgcttggagctgtgctgtcttatttgattggtgccgttgtggtttatttggtcatgctatcacttggggaattggcggttgccatgccggtgacggggtcattccacacttatgccactaagtttatcagtcctggaacaggttttactgttgcttggctatattggatttgttggacggtcgccttggggactgaatttttaggtgctgccatgctgatgcagcgctggttcccaaatgtgccggcttgggcatttgcttccttttttgcccttgtgatttttggtttaaatgctcttagcgtacgcttttttgcagaagcagagtctttcttctcaagtattaaggttattgctatcattatctttattatcttgggcttaggtgctatgtttggtctagtttcctttgaaggtcagcacaaggctattctcttcactcatctgactgccaatggtgcctttccaaatggtatcgttgcagttgtctcagtcatgttggctgttaactatgccttctctggtactgagttaattggtattgcggctggtgaaacggataatcccaaagaagctgtaccaagggctattaaaacgacaatcggtcgcttggttgttttctttgtactgacaattgttgtcctagcttcgctattgccaatgaaagaggcaggcgtatccacagcaccattcgttgatgtctttgacaagatgggaatcccttttacggcggatatcatgaacttcgttatcttgacagccatcctgtctgctggtaactcaggtctctacgcatcaagccgtatgctctggtcccttgccaatgaaggtatgttgtcaaaatctgttgtgaaaatcaataaacacggtgtcccaatgcgtgctcttctcttgtcaatggcaggagcagtgctgtcgctcttttcaagtatttacgctgcagacacagtttatctagccttggtttcaatcgcgggctttgctgttgttgtcgtatggctagccattccagtcgcacaaatcaatttccgcaaggaattcttgaaagagaatcaactagaagatttgtcttacaaaacaccttttacaccagttctcccttatatcacaatcattttgctcttgatttcgattgtagggattgcttgggatagctcacaacgtgctgggctttacttcggtgttccatttattattttctgctatatttatcacaaactacgttacaagaaatgg

SEQ ID NO: 9378 - protein, 458 aa, Streptococcus agalactiae
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 9379 - DNA, 684 bp, Streptococcus agalactiae
atgagagtattaattgcagaagatgaagaacagatgtcacgtgtccttagtacggcaattagtcaccaaggttatgttgttgatgtcgcctacgatggtcagactgctattgatttagctaatcaaaatgcatatgatgtcatggttatggatgtcatgatgcctgttaaaacaggtattgaggctgtcaaagaaattagacaatcaggaaataaatctcacattattatgctaacagccatggcagaaattgatgatagagtaacaggtctagatgctggtgcagatgattatttaacaaaacccttctctctaaaagaattattagcaaggcttcgctctatgtcccgaagattggaagatttcacacctaatgtattgtcattgggaagagtaaccttatcagtcggtgaacaagagttgcaatgtgaaaacactattcgtctagcgggtaaagaagctaaaatgttagcatttttcatgttgaaccatgataaagaattatctacacaacaacttttcgaacatgtctggggagcagataaggaccaagaagatgtagatgagggatacgtctttatctatgtttcttatttgagacaaaaattgcaggcaattggtgctaacttggagattattggtcaagaaggtagtagctataaattaagtgaaataaatggtggc

SEQ ID NO: 9380 - protein, 228 aa, Streptococcus agalactiae
MRVLIAEDEEQMSRVLSTAISHQGYVVDVAYDGQTAIDLANQNAYDVMVMDVMMPVKTGIEAVKEIRQSGNKSHIIMLTAMAEIDDRVTGLDAGADDYLTKPFSLKELLARLRSMSRRLEDFTPNVLSLGRVTLSVGEQELQCENTIRLAGKEAKMLAFFMLNHDKELSTQQLFEHVWGADKDQEDVDEGYVFIYVSYLRQKLQAIGANLEIIGQEGSSYKLSEINGG

SEQ ID NO: 9381 - DNA, 687 bp, Streptococcus agalactiae
atgcgttggttcgaatccagctaccccagtttcacatggtccgttggtcaaggggttaagacaccgccttttcacggcggtaacacgggttcgaatcccgtacggactatcgtggccagttgcattttagcggctggtttttcttttattttcaaaaatatcggagttactatggaatactttaacgttggaaaaattgtcaatacacaaggattacaaggcgaaatgcgtgtattaagcgtgactgactttgtagaagaacgctttaaaaaaggtcaagtgttagctttattcgatgaaaagaatcagtttgttatggatattgaaattgctagtcatcgtaagcagaagaattttgacattataaaattcaaaggaatgtatcatattaatgatattgaaaaatataaaggtttcacactgaaggtggcagaggatcaactgagcgaccttaaagatggtgaattttattatcatgaaattattggcttagatgtctatgaaggggaagagctgattggaaaaatcaaagaaattttacaaccaggagcaaatgacgtttgggttgtggaacgtcatggaaaacgtgatcttttattaccctatatcccgccagtagtattagaagtggacctttctaatcagcgtgttcaagttgaattgatggaaggtttagatgatgaagat

SEQ ID NO: 9382 - protein, 229 aa, Streptococcus agalactiae
MRWFESSYPSFTWSVGQGVKTPPFHGGNTGSNPVRTIVASCILAAGFSFIFKNIGVTMEYFNVGKIVNTQGLQGEMRVLSVTDFVEERFKKGQVLALFDEKNQFVMDIEIASHRKQKNFDIIKFKGMYHINDIEKYKGFTLKVAEDQLSDLKDGEFYYHEIIGLDVYEGEELIGKIKEILQPGANDVWVVERHGKRDLLLPYIPPVVLEVDLSNQRVQVELMEGLDDED

SEQ ID NO: 9383 - DNA, 1509 bp, Streptococcus agalactiae
ttgctatttgattttctcgaagaaaaaataaaactgaaagcatacctgatgaccgccttacttgatgatggagaaattaaccttgatcactttaaaacagaatatgctttgagtgaaaagattttacaaggtcttatttcggaactacaaatactttattctgatttctaccttgttgtcaaaagtagaacaatggtattgttccattacgaaacactttctaagctagagactttgcataccatttatcgagagtctaatacgttacagtttttggcatattttattgctcctcaaaatgtcagtttttctgaattcacggctaagaaattcatatccgtcgcaagtgcctaccgaataaagaaaaactgtaaactttatttggagagtgttaagttatcaatacaaaaaaataaagtgacaggtccagaatatcagattaggctgctgattgctttgttacagtatcattttggttttattatttatccttttgatgctacaagtgaggtaatgataagggattttattgaatactcgaattttaaagggtgtgactacgaccttaaagacttatctgaagaatattactatttttatattttggtgaatttagtttggaaaagaaaagaatataaagtagaaattcctcaaacagaatcctttaatcaactaaaaaaatctattctctacatggagttatccaaagcagctcaaaagagtattgctatacatcttggtatagagttgaatgaaggtttacttgattatctatatttagtgttttgtattagtgatggtcctctatttagcaatcgagatgatatcaatatcaacgaagaatttatttttgcttcttataagatatcaaagtctaaagcctttaagaatttttgtggtcgattattgggtagagaatttattgactcgcagcattttaaagatattaatgcctattttttgagacattttatttgttattgttattattttattcctgatttttattttttaaatacatcaaggctgagctattctaaggatttatatcacctattagataaaggtctggctgatatttttaaccttaaaggagggaatttaactttttcaaaacatgagacagtgctactaacaatgcaattatctaacttaatagagactttcttagctcctctttctgtatatgtaatttcatctagtaatattagattacaaacctatcaagtaatgttaaaccaatattttacatctaagatagcggaattcttttttgtaaactatcaaacgactcagatagatgaaaaattactaaaaaaagcagatatcattattgctgagagacgctatatatcttctttaaaaaatgactcaggtgtggctatacaagatatattagaaattgggatgaataataagcagtaccatgaactacttttacaagctattatcgaaaaaagggaccaaaaagtttttgaatatatttcaaaaatgaaacataaaatactt

SEQ ID NO: 9384 - protein, 503 aa, Streptococcus agalactiae
MLFDFLEEKIKLKAYLMTALLDDGEINLDHFKTEYALSEKILQGLISELQILYSDFYLVVKSRTMVLFHYETLSKLETLHTIYRESNTLQFLAYFIAPQNVSFSEFTAKKFISVASAYRIKKNCKLYLESVKLSIQKNKVTGPEYQIRLLIALLQYHFGFIIYPFDATSEVMIRDFIEYSNFKGCDYDLKDLSEEYYYFYILVNLVWKRKEYKVEIPQTESFNQLKKSILYMELSKAAQKSIAIHLGIELNEGLLDYLYLVFCISDGPLFSNRDDININEEFIFASYKISKSKAFKNFCGRLLGREFIDSQHFKDINAYFLRHFICYCYYFIPDFYFLNTSRLSYSKDLYHLLDKGLADIFNLKGGNLTFSKHETVLLTMQLSNLIETFLAPLSVYVISSSNIRLQTYQVMLNQYFTSKIAEFFFVNYQTTQIDEKLLKKADIIIAERRYISSLKNDSGVAIQDILEIGMNNKQYHELLLQAIIEKRDQKVFEYISKMKHKIL

SEQ ID NO: 9385 - DNA, 1176 bp, Streptococcus agalactiae
atggcaagaatcccttatcagaaaacacttattttttgtgtagccgttattattgctatttttattttggggttatctaaggatttagcacaatctaaagggcaaaaggttgcaaataataatactgtaaaaacagcacgtgtggttgcaaacggagatattttgctgcacgatgtactatatgccagtgcgcgccaacccgacggcacttataattttactccttattttaaagaggtaaaatcttggattgagagcgctgatttagcgattggtgattatgaagggacgattagttcagaatatcctttagcgggctatcctttatttaatgctcctaatgagattgcaactactatgaaagaaactggatatgatgtcgttgacttagcacataatcatattctggattcacaactggcaggtgctatcaatactgtcaagacttttaatcgtctgggattggatactattggggtttatttaaaggatagaaataaagaagatatcttaattaagcatgtaaatggtattaaaattgctattttaggttattcgtatggctacaatggtatggaagctaatgtttcaaagagtgactatgaaaaacatatgtctgatttagatactaaaaagattaagcaagatattaaaaaggctgaaaaagaagcagatatcaccattgtcatgccacagatggggatagaatatcaaaaaaaacctactacagaacaagtaatgctttatcatagtatgattaaatggggggcagatattatattcggaggacaccctcacgttgttgaaccgtctgaagtgataaaaaaagatggccagaaaaaatttattatttactctatgggaaattttatttcaaatcagcgtttagaaacggttgatgatatctggacagaaagaggattattaatggatgtaaccatagagaaaaaaggtcaaaaaacagtaattaaaaaagttaaggcgcatccaacactagtagaagcaaaaccaaatggccgttatgttgaagaaggctttccagcttatgattataggacgctagttttagaggattatattgaaggtggtaagaaacgttctacgattgatcagactatgaaagataaagttgataaagcatataaggagatgaatgagttagttaatttgaagtgg

SEQ ID NO: 9386 - protein, 392 aa, Streptococcus agalactiae
MARIPYQKTLIFCVAVIIAIFILGLSKDLAQSKGQKVANNNTVKTARVVANGDILLHDVLYASARQPDGTYNFTPYFKEVKSWIESADLAIGDYEGTISSEYPLAGYPLFNAPNEIATTMKETGYDVVDLAHNHILDSQLAGAINTVKTFNRLGLDTIGVYLKDRNKEDILIKHVNGIKIAILGYSYGYNGMEANVSKSDYEKHMSDLDTKKIKQDIKKAEKEADITIVMPQMGIEYQKKPTTEQVMLYHSMIKWGADIIFGGHPHVVEPSEVIKKDGQKKFIIYSMGNFISNQRLETVDDIWTERGLLMDVTIEKKGQKTVIKKVKAHPTLVEAKPNGRYVEEGFPAYDYRTLVLEDYIEGGKKRSTIDQTMKDKVDKAYKEMNELVNLKW

SEQ ID NO: 9387 - DNA, 357 bp, Streptococcus agalactiae
atggctcgtgttaaaggtggagttgtttcacgtaaacgtcgtaaacgcgtacttaaattagctaaaggttactatggtgcaaaacatatcttgttccgtactgcaaaagaacaagtaatgaattcttactactatgcataccgtgaccgtcgtcagaaaaaacgtgacttccgtaaattatggatcactcgtatcaatgcggctgctcgtatgaatggtttatcatattcacaattgatgcacggtttgaaattagctgaaatcgaagttaaccgtaaaatgcttgctgatttagcagttaacgatgcagcagctttcacagctcttgcagatgcagctaaagctaaacttggtaaa

SEQ ID NO: 9388 - protein, 119 aa, Streptococcus agalactiae
MARVKGGVVSRKRRKRVLKLAKGYYGAKHILFRTAKEQVMNSYYYAYRDRRQKKRDFRKLWITRINAAARMNGLSYSQLMHGLKLAEIEVNRKMLADLAVNDAAAFTALADAAKAKLGK

SEQ ID NO: 9389 - DNA, 522 bp, Streptococcus agalactiae
atggcgaaaaaaccatgggaaaaaaaagttgtggaaaacaatagtcatagaaaagacaaaattacaagaacgagtagaggtgtggtgtcaagtactccttggattaccgctttcttgagtgcattctttgttattgtcgttgctattttatttatagtattttatacttcaaatagaggagaagacagagcaaaagaaacttctggtttttatggtgcttcaagccaaaaagttaatagttctaaaacgaaaaaagcatctacaagtaagaaaacaacgtcatcatcaaaaactaaaactagtgataaatcaacaacatcttctagtactgtagcaagttcgagtgagacatcgacatcatcttcagtaaacggtggaacaatcgtagttcaaccaggtgagggagcagcctccatagctgctcgtgcaggtatctcagttgctcgtttacaagaacttaatcccagtcatatgacctcagggtattggtatgctaatccaggcgatcctgtggttgtaaat

SEQ ID NO: 9390 - protein, 174 aa, Streptococcus agalactiae
MAKKPWEKKVVENNSHRKDKITRTSRGVVSSTPWITAFLSAFFVIVVAILFIVFYTSNRGEDRAKETSGFYGASSQKVNSSKTKKASTSKKTTSSSKTKTSDKSTTSSSTVASSSETSTSSSVNGGTIVVQPGEGAASIAARAGISVARLQELNPSHMTSGYWYANPGDPVVVN

SEQ ID NO: 9391 - DNA, 210 bp, Streptococcus agalactiae
gtgaaaatgttacaatatcttgaggaggtgaaacatatgtcaaaaacagtagtacgtaaaaacgaatcacttgacgatgcacttcgtcgtttcaaacgttctgtgactaaagctggtactcttcaagaatcacgtaaacgtgaattctacgaaaaaccttctgtaaaacgtaaacgtaaatcagaagcagctcgcaaacgtaaaaaattc

SEQ ID NO: 9392 - protein, 70 aa, Streptococcus agalactiae
MKMLQYLEEVKHMSKTVVRKNESLDDALRRFKRSVTKAGTLQESRKREFYEKPSVKRKRKSEAARKRKKF

SEQ ID NO: 9393 - DNA, 1026 bp, Streptococcus agalactiae
atggtaactataaaagatgttgctgccaaagctggtgttaatccatcgacagtaagtcgtgtactaaaagataatgcatctatttcaagtaagacgaaagagcgcgtgaaaaaagctatggaagagctgggctatgttcctaatgttgcagcacaaatgttggctagtggtttaacgcaaaatattggagttatttttcctccactggttttaccagaccgcttaagtgaaccctttttcatggagattctttctacattaactaatgaagcaaaagagcatgagtttacagtttctattgcaacaagtatgtcttctgaggagttgttagaacaagtaaaattaatgcatctacaaaaacgagtggatggttttattgttctctattcggatcaaaaagatcctatcagagagtatttattaaaatataaactgccctttgttgttgttggtgctgctaatggctatgaaaatgagattacttatattgataatgataatcagctgatggggaaatctgccattgattatctctataaaaaaggacataaaagcatccagtttgttacagatgatttaaattcagaagtatcagaagagcgctatttagggtattttaaaggtgctagaaagttaggtttaaaccaaaagccagctcttttatttgacagaggcaatccgcaagttttagaggaatttataaatagagtcaaagaagaagaaacaactgctttaattgttattggtgatactgtctctgttagagtaatgcaatttctttctttctataaattaaaagttccagatgacatttctatcatgacctttaataattctctcttctcacatctgattcatccttacctaagcacatttgatattaatgttaataatctaggaaggacaagcgttcgtcgtctgattgacatcattaaatctccagacaaagtctttagtgagactattattgtgccttttactttagaagagcgtgaaagtgtccgagatatttctaaaaataataat

SEQ ID NO: 9394 - protein, 342 aa, Streptococcus agalactiae
MVTIKDVAAKAGVNPSTVSRVLKDNASISSKTKERVKKAMEELGYVPNVAAQMLASGLTQNIGVIFPPLVLPDRLSEPFFMEILSTLTNEAKEHEFTVSIATSMSSEELLEQVKLMHLQKRVDGFIVLYSDQKDPIREYLLKYKLPFVVVGAANGYENEITYIDNDNQLMGKSAIDYLYKKGHKSIQFVTDDLNSEVSEERYLGYFKGARKLGLNQKPALLFDRGNPQVLEEFINRVKEEETTALIVIGDTVSVRVMQFLSFYKLKVPDDISIMTFNNSLFSHLIHPYLSTFDINVNNLGRTSVRRLIDIIKSPDKVFSETIIVPFTLEERESVRDISKNNN

SEQ ID NO: 9395 - DNA, 1470 bp, Streptococcus agalactiae
atggaaaaaacaaaatcattctttggacatcctcgtggtttgtccactcttttctttactgaaatgtgggaaagattctcatactatggtatgcgtgctattttgctgtactatatgtactatagtgtttctcaaggtggccttggtatggacaagactgtcgctgcatcaatcatggctgtctatggttcactggtttatctctcatcagtaattggtggttttgtcagcgaccgtattctaggtagtcgtaaaactgttctgtatggtggtattctaatcatgctaggtcatattgctctagctacaccatttggtcaaacagctctattcatttcgattgctctaattatccttggtactggactattaaaaccaaatgtatcagagatggttggtaatttatatggagaaaatgattctcgtcgtgatgctggttttagtatctttgtttttggtattaaccttggtgcttttatttcacccattgtagtggggtacctcggacaagaagtaaatttccatcttggtttctcacttgctgctattggtatgttctttggtctcctccaatataccttagatggaaaaaaatatttgactgaagagagtctcagaccaaacgatcctttaagtcctgaagaaaagtcctctctatataaaaaagttgggcttatccttattggtattgttattgtacttattctacttcacttgatgcatatgctaacaattgaagtaattatcgatatttttagtattattgcaatcgccatcccaattatttattttatcaagattttaagtagtaaaaagatttcttctgttgagcgttctcgagtgtgggcatatatccctctctttatcgcctcaattctattttggtcaattgaagaacaaggttcagttgtcttagccttatttgcagatgaacaaacaaaactttaccttaacttctttgggcatcatattaatttcccatcaagttatttccaaagtatgaaccctctcttcattatgctttatgtaccattctttgcttggttatgggctaaatggggaagtaagcaaccttcatcacctaaaaaatttgcgtatggacttttctttgctggagcttcattcttatggatgatgctaccaggtttactctttggagttaacgctaaagtaagccctctttggttaacaatgagttgggctattgtcatcgttggggaaatgctaatctcaccagttggattatcagcaactagtaagctcgcacctaaagcattccaagctcaaatgatgagcatctggttcttaagtaatgctgcagcacaagctattaacgctcaaatcgttaaattgtacacacctgatactcaaactctttattatggtgttgttggtggtataacagttgtatttggatttatcctcttattttatgttccacgcattgaaaaactaatgtctggagttaaa

SEQ ID NO: 9396 - protein, 490 aa, Streptococcus agalactiae
MEKTKSFFGHPRGLSTLFFTEMWERFSYYGMRAILLYYMYYSVSQGGLGMDKTVAASIMAVYGSLVYLSSVIGGFVSDRILGSRKTVLYGGILIMLGHIALATPFGQTALFISIALIILGTGLLKPNVSEMVGNLYGENDSRRDAGFSIFVFGINLGAFISPIVVGYLGQEVNFHLGFSLAAIGMFFGLLQYTLDGKKYLTEESLRPNDPLSPEEKSSLYKKVGLILIGIVIVLILLHLMHMLTIEVIIDIFSIIAIAIPIIYFIKILSSKKISSVERSRVWAYIPLFIASILFWSIEEQGSVVLALFADEQTKLYLNFFGHHINFPSSYFQSMNPLFIMLYVPFFAWLWAKWGSKQPSSPKKFAYGLFFAGASFLWMMLPGLLFGVNAKVSPLWLTMSWAIVIVGEMLISPVGLSATSKLAPKAFQAQMMSIWFLSNAAAQAINAQIVKLYTPDTQTLYYGVVGGITVVFGFILLFYVPRIEKLMSGVK

SEQ ID NO: 9397 - DNA, 1386 bp, Streptococcus agalactiae
atgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgctttcatgttcttcatgatgcgtgctattggagagatgctttatcaagatccaaatcagcatacttttattaatttcattaccaaatatttaggacccggttggggatttttctcaacactttcttattggatttccctaatatttatcggtatggcagagattacagccgtaggagagtatgttcaattttggttccctgaatggccatcctggattatccaaattgtttttttagctatcctaagttctatcaacttaattgctgtaaaagcattcggagaaaccgagttttggtttgctatgataaaagttattgcaattcttggtttaatagcaaccggtatctttatggtattgacaaactttgacaccggtcacggataccatgcttcaatctcaaatatcaccaatcattttgaatggttccctaaaggtaaattgaatttcttcatggctttccaaatggtattctttgcttatttagctattgaatttgtcggagtaacaacttctgaaacagctaatccacgtaaagttttaccaaaagcaatccaagaaattccgatgcgtattattttattctacgcaggttcattattagcaattatggccatcttcccatggcaacagttaccagttaatgagtcacctttcgttacagtattcaaactagctgggattaagtgggctgccgctttgattaactttgttgtcctaacgtctgcagcatctgctcttaattctactttgtactcaacagggcgtcatttattccaattggctaatgaatcaccaaatgctcttacaaaagcgttaaaattagaccaattatctcgtcaaagcgttccaagtcgagctattattgcatcagctgtaatcgttggagcttcagcacttatcagtgttttacctggtatttcagatgccttctccttaattactgcatcatcttctggtgtttacatttctatctatgttcttattatgattgcacattggaaatatcgtaaatcacctgattttatggaagatggttataaaatgcctgcctacaaaatcctttcaccaatcacacttctcttcttcctctttgtattcgtttctctcttcttgcaagattcaacatacatcggggctattggagcaaccatctggattattggatttggtttatatagtcacttcaaacataaatcacat

SEQ ID NO: 9398 - protein, 462 aa, Streptococcus agalactiae
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 9399 - DNA, 2403 bp, Streptococcus agalactiae
atgaaagaaaaaattataaaatatttggaagaacacggtaaaaccagcgttaatgatttagctgctgccctagatatggcaggcgcaaaagcatttccaaaattaatcaaaacaatctcaaatttggagagccacaggcaattaagatttgacgataatggaagtctttctcttcaaaagaaagaagctaagaaaaaggaaatcacagtaaggggtctttttagagcaaataaagcaggatttggttttcttagtattgaccaagacgaagatgatatgtttatcggaaaaaacgatattgcttatgctattgatggtgacacggtagaagctgttgtaaagaaaccagcggaccgtcttaacgggactgcagcagaagcgcgtgttgttaatattgttgaacgtagtttaaagacgcttgttggtaagtttgtcttagacgatgagcgccctaaatacgcaggatatatcaaatcgaaaaatcaaaaaatcaatcaaaagatttatatacgcaaagaaccggtcgttttagacggaacagaaattatcaaagtagatattgataaatatccgacacgaggacatgattacttcgtagcaagtgttcgtgatatcgttggacatcaaggagatgttggtattgatgttttagaagtcttggaaagtatggatatcgtctcagaatttcctgaggacgttattgcagaagccaatgctatcccagatgctccaacggagaaagatttaattgggcgtgttgatttacgtcaagaggtcactttcactattgatggagcggacgccaaagatttagacgatgctgtgcatattaaattactggataatggtcattttgaacttggagttcatatcgcagatgtatcatactacgttactgaaggctctgccttaaatcgtgaagcacttagtcgtggtacgtccgtatatgtcacagatcgcgttgtaccaatgttaccagagcgtctatctaacggtatatgttcattaaatccaaatcttgatcgtttaacgcagtcttgtattatggaaattgaccaaaatgggagagttgttaatcatcaaattacacagtcagtgattaataccacttatcgtatgacttataccgctgtaaatgatattattgctggcgatgaggaaatctgctcagaatatgagtctattgtgtcctcagtacagcatatggtcactttacaccatactttggaagctatgcgtacgcgtcgtggagcgctgaattttgacacatctgaagcaaaaattatggttaatgataagggaatgccagttgatattgttattcgcaacagaggcattgctgaacgcatgattgagtcatttatgttggcggcaaatgaaacggttgctgaacattatgctcgtctaaaactgccatttatttatcgtatacacgaagagcctaaagctgaaaaattacaaaaattcatcgattatgcttctgttttcggtgttcagattcaaggaacagcaactaaaatcacccaatctgctttacaggactttatgaaaaaagtacaagggcagccaggaagtgaagtgttatctatgatgttattgcgctcgatgcaacaagctagatattctgaacacaaccatggacattatggacttgctgcggaatattacactcactttactagccccattcgacgttatccagacttgttagttcatcgtatgattcgtgattatgatgataaagcgatggataaagctgatcattttgctaaccttatcccagaaattgcaactcaaacgtctagtcttgagagacgtgccattgatgctgaacgtattgtagaggcaatgaagaaagccgaatatatggaagaatatgttggtgaggaatttgaaggtgtggttgcaagcgttgttaaatttggtatgtttgtagaattaccaaatactattgaaggattgattcacgtaacgaccttgcctgaatattatcactttaatgaacgtacgctgacgcttcaaggtgagaaatctgggaaagttttccgtgttggtcaacaaattaaggttaagttgattcgttctgataaggaaactggtgatatcgattttgattatttaccatcagattttgatattgttgaaaaggtaagtaaaagttcgcgtgagggtcgtcctaatagaagttctaaacgagaacatcagcatagaatttctgatcgtgataataagaataaaaatacatctaagaaaaaagcatctcgaaaacccaaaaggaactcggatagcaaatcacatcatcataaagacgatagaacaacaggttcaaccaagaaaaaaacgaaaaaacctttctataaaggcgttgctaagaaaggtcagaaacggaaatctaagaaaggt

SEQ ID NO: 9400 - protein, 801 aa, Streptococcus agalactiae
MKEKIIKYLEEHGKTSVNDLAAALDMAGAKAFPKLIKTISNLESHRQLRFDDNGSLSLQKKEAKKKEITVRGLFRANKAGFGFLSIDQDEDDMFIGKNDIAYAIDGDTVEAVVKKPADRLNGTAAEARVVNIVERSLKTLVGKFVLDDERPKYAGYIKSKNQKINQKIYIRKEPVVLDGTEIIKVDIDKYPTRGHDYFVASVRDIVGHQGDVGIDVLEVLESMDIVSEFPEDVIAEANAIPDAPTEKDLIGRVDLRQEVTFTIDGADAKDLDDAVHIKLLDNGHFELGVHIADVSYYVTEGSALNREALSRGTSVYVTDRVVPMLPERLSNGICSLNPNLDRLTQSCIMEIDQNGRVVNHQITQSVINTTYRMTYTAVNDIIAGDEEICSEYESIVSSVQHMVTLHHTLEAMRTRRGALNFDTSEAKIMVNDKGMPVDIVIRNRGIAERMIESFMLAANETVAEHYARLKLPFIYRIHEEPKAEKLQKFIDYASVFGVQIQGTATKITQSALQDFMKKVQGQPGSEVLSMMLLRSMQQARYSEHNHGHYGLAAEYYTHFTSPIRRYPDLLVHRMIRDYDDKAMDKADHFANLIPEIATQTSSLERRAIDAERIVEAMKKAEYMEEYVGEEFEGVVASVVKFGMFVELPNTIEGLIHVTTLPEYYHFNERTLTLQGEKSGKVFRVGQQIKVKLIRSDKETGDIDFDYLPSDFDIVEKVSKSSREGRPNRSSKREHQHRISDRDNKNKNTSKKKASRKPKRNSDSKSHHHKDDRTTGSTKKKTKKPFYKGVAKKGQKRKSKKG

SEQ ID NO: 9401 - DNA, 1167 bp, Streptococcus agalactiae
gtggcttggctcggtaatttttttactggggcaagcttttcacttgttatgccttttatggtattatatgtagaacaattaggagcacctagcaacaaagtagagtggtatgcaggcctatcagtatccttatcagccttgtcttcagctttagttgccccattatgggggcgcttagctgataaatatggtagaaaaccgatgatggtaagagcagggttgatgatgacttttactatgggaggtcttgctttcattcatagtgttacaggacttctgattttacgtatattaaacggcatttttgcaggctatgtacctaactctacagctttgatagcaagtcaagctcctcaagaggaatcaggatatgccttaggaaccttagcgacaggagtgactggaggtatgttaattggtccacttttagggggacttttagcagagtggtttggtattagggaagtttttttattagtgggaaccatattgttaatatctactttaatgaccatttttatggtaaaggaagatttcaaacccatttctaacgaagaaaccatgccaactacagaagtgttcaaaagcgttaaaagcttacaaattttaatagggctgtttgtaacaagcatgattattcaaatttctgcacaatcaattgcacctattttaacactttacattcgtcatttaggacagactgaaaacttgatgtttgtttccggattaattgtttctggtatgggattctctagtattctgagtagtccaaagctaggaagaatcggggatcgcataggcaatcatcgtttgctattattagctctactgtatagtttcctcatgtatgtcttatgttcattggcacagacttcattacagctaggggttattagattcctgtatggttttggaacaggtgccttgatgccgagtattaattcaatcttgactaaaattgctccaagacaaggtttatcaaggattttcagttataaccaaatgtttagcaatttaggacaagtattaggtccttttgtcggttcagcagtttctattcatttaggattccgatgggttttctttgtgactagcttcatcgttttagctaattttgtttggtgttttattaattttagaaaatatattagagttaaggaaattgtg

SEQ ID NO: 9402 - protein, 389 aa, Streptococcus agalactiae
MAWLGNFFTGASFSLVMPFMVLYVEQLGAPSNKVEWYAGLSVSLSALSSALVAPLWGRLADKYGRKPMMVRAGLMMTFTMGGLAFIHSVTGLLILRILNGIFAGYVPNSTALIASQAPQEESGYALGTLATGVTGGMLIGPLLGGLLAEWFGIREVFLLVGTILLISTLMTIFMVKEDFKPISNEETMPTTEVFKSVKSLQILIGLFVTSMIIQISAQSIAPILTLYIRHLGQTENLMFVSGLIVSGMGFSSILSSPKLGRIGDRIGNHRLLLLALLYSFLMYVLCSLAQTSLQLGVIRFLYGFGTGALMPSINSILTKIAPRQGLSRIFSYNQMFSNLGQVLGPFVGSAVSIHLGFRWVFFVTSFIVLANFVWCFINFRKYIRVKEIV

SEQ ID NO: 9403 - DNA, 924 bp, Streptococcus agalactiae
atgaaaaagtggttagttattgtatcatgttttgtagcatttttaggcttaggtgcctgtgctaacaagcaggatcaagccaaaaacgaaaaattaaaagtagttgtaaccaactctattttggcagatataacaaaaaatatagccggtaacaaaatcgacttacatagtattgtacctgttggtaaagatcctcatgaatatgagccattaccagcagacgttgaaaaaacaactcaagcagaccttgttttttacaacggaattaatcttgaaacaggcggtaatgcttggtttacaaaattaataaagaacgctaagaagaaagaaaacaaagattactttgcggttagcgatggagttgatgttatttatctaaatggtcaaagcggaaaaggtaaagaagacccacatgcttggttgaaccttgaaaatggtattatttactcaaaaaatattgctaagcaattaattgctaaagatccaaaaaacaaagctacttatgagaaaaacagagatgcttatgtagctaaattagaaaaattggataaagaagcaaaatctaaatttaatgccattccagctaataaaaaattaattgttactagtgaaggttgctttaaatatttctcaaaagcttatggagttccatcagcatacatctgggaaattaacactgaagaagaaggtacaccagatcaaattactagcttagttaagaaattaaaacaagtaagaccttcagctttattcgttgaatcaagtgttgacaagcgtcctatgaaatctgtttcaagagaatcaggtatcccaatttacgcagaaatcttcacagactcaattgctaaaaaaggtcaaaagggtgacagctactacgctatgatgaaatggaatcttgataagattgcagaaggtttagcaaaa

SEQ ID NO: 9404 - protein, 308 aa, Streptococcus agalactiae
MKKWLVIVSCFVAFLGLGACANKQDQAKNEKLKVVVTNSILADITKNIAGNKIDLHSIVPVGKDPHEYEPLPADVEKTTQADLVFYNGINLETGGNAWFTKLIKNAKKKENKDYFAVSDGVDVIYLNGQSGKGKEDPHAWLNLENGIIYSKNIAKQLIAKDPKNKATYEKNRDAYVAKLEKLDKEAKSKFNAIPANKKLIVTSEGCFKYFSKAYGVPSAYIWEINTEEEGTPDQITSLVKKLKQVRPSALFVESSVDKRPMKSVSRESGIPIYAEIFTDSIAKKGQKGDSYYAMMKWNLDKIAEGLAK

SEQ ID NO: 9405 - DNA, 645 bp, Streptococcus agalactiae
atgactccaaataaagcagattacctaaaatgcattcatgaattaggtgaaaaaaacaacaaaatttccaataagaaaatcgctgaaatgatgcaagtctcggctcctgccgtgtcagaaatgattaaaaaaatgataagtgaacaactgattgttaaagataaagatttaggatattatcttaccaaacaaggtttattagttgtttctgacctttaccgtaaacatcgtctagtagaggtatttttagttaaccatttgcactatactgctgatgatattcatgaagaagcggaagttttagaacatactgtatcaacaacttttgttgatcaattagaaaagttgttagactttccacaattttgtccacacggtgggactattcctaaaaagggagagtttttagtagaaattaaccaaatgacattggaccaaattagtcagcttggcacatatgttatcagtcgtgttcatgatgattttcagctactgaaatacctagaacaacaccgtttgcatatcaacgataccattgaattgacacaaattgacccttatgcaaaaacttatcacatcacctataacgatgaaaatctaacaatccctgagcgtatcgcaagtcaaatatatgtatctgctaca

SEQ ID NO: 9406 - protein, 215 aa, Streptococcus agalactiae
MTPNKADYLKCIHELGEKNNKISNKKIAEMMQVSAPAVSEMIKKMISEQLIVKDKDLGYYLTKQGLLVVSDLYRKHRLVEVFLVNHLHYTADDIHEEAEVLEHTVSTTFVDQLEKLLDFPQFCPHGGTIPKKGEFLVEINQMTLDQISQLGTYVISRVHDDFQLLKYLEQHRLHINDTIELTQIDPYAKTYHITYNDENLTIPERIASQIYVSAT

SEQ ID NO: 9407 - DNA, 1341 bp, Streptococcus agalactiae
ttgcttatggtaaaaaaaggctttttaacgggattactcttatttggtatcttctttggtgcagggaacctcatttttccaccagcattaggtgtagcatctggacaagatttctggccagcgattttaggattttgtttgtcaggagttggattagctattattaccctcctactaggcacactaactaatggtggttataagacagagatgtcggaaaaatttagtccgtggttttctttaacatttttagttatactctacctaactattggtccactttttgctattcctagaacagcaacggtttcttttgaaattggggttgctccaattgtagggcatagtccgattgctcttttgtgttttacagcctgtttttttgctgcagcttattatctcgctattagaccaaatggtatattagatagtgttggaaaaatcttaacgcctgtttttgcctttttaattctctctttggttgttgttggagctattgcttatggaaacttggagagtgctaaggcgagtgctgactatgcaggaaaagcgtttggaagtggtgtcttagcaggctataatacacttgatgcacttgcagcagttgctttttgtctagtagcaacagaaacgcttaaaaagtttggttttaaaactaaaaaagaatatttatcaaccatttggattgttggaattgttactagtttagcatttagtattttatatattggcttaggttttttagggaataagtttcctgtcccagctgatattttagctgacccaaatgttaataaaggagcttatgtattatcacaagcatcttataaattatttggaaattttggtcgttatttcttgagtattatggtaacattgacatgctttacaacaacagttgggcttattgtgtcagtatctgaattttttgataagaactttcgttttgggaattataaattatttgctactgtttttactttgattggctttttaattgctaatcttggtttaaatgctgtaattactttttcagttcctgtgctaactttattgtatccgattgttattgttattgtcttaattattttgattaataagtggttgccgctttcaaaaaagggaatgtctttgacaattggtcttgtcactttagtgtcgtttgttgaggttctagcgggacaatggcaagaaaaaacattaactcagttagttggattcctcccctttcatactatttcaatggggtggctagttccaatgttgattggtatagtattttctttggtgctgtcagataaacaaaaaggccaagcatttgatttagagaaatttgaagga

SEQ ID NO: 9408 - protein, 447 aa, Streptococcus agalactiae
MLMVKKGFLTGLLLFGIFFGAGNLIFPPALGVASGQDFWPAILGFCLSGVGLAIITLLLGTLTNGGYKTEMSEKFSPWFSLTFLVILYLTIGPLFAIPRTATVSFEIGVAPIVGHSPIALLCFTACFFAAAYYLAIRPNGILDSVGKILTPVFAFLILSLVVVGAIAYGNLESAKASADYAGKAFGSGVLAGYNTLDALAAVAFCLVATETLKKFGFKTKKEYLSTIWIVGIVTSLAFSILYIGLGFLGNKFPVPADILADPNVNKGAYVLSQASYKLFGNFGRYFLSIMVTLTCFTTTVGLIVSVSEFFDKNFRFGNYKLFATVFTLIGFLIANLGLNAVITFSVPVLTLLYPIVIVIVLIILINKWLPLSKKGMSLTIGLVTLVSFVEVLAGQWQEKTLTQLVGFLPFHTISMGWLVPMLIGIVFSLVLSDKQKGQAFDLEKFEG

SEQ ID NO: 9409 - DNA, 1164 bp, Streptococcus agalactiae
atggaaaagagacttagtttaggagcgcttgttttagctagtacagttcttttagcagcatgtggaaatgtcggaggaggagcatcttcgacaggaacaaaaatagggaaagatattaaggtagggtataactgggaattatcaggaaacgtttcttcgtatggaaattcaatgaagaatggagctgacttagcagtaaaagaaattaatgctgctggaggggttggcggcaagaagttaaaagtcctatcacaggataataaatcagaaaatgcagaggcagcaacggttgccacaaacttggttaccaaaggagctaatgtcattatcggaccagcaacatcgggtgcagctgcatcttcaactccaaaagtaaatgcagcagcagttccaatgattgcacctgctgcgacacaagacaatttagtctatggttctgatggaaaaaccttaaatcagtatttcttccgagctacttttgtcgataattatcaaggaaagctattgtctcagtatgctacagacaaccttaaagctaaaaaagttgttctattttatgataattcatcagattactcaaagggggtagcaaaatcatttaaggaaagttatagtggaaaaattgttgatagtatgacattctccgctggtgatactgatttccaagcgtcattgactaagttgaaagggaaagaatatgatgctattgtgatgccaggttactataccgagacaggattaatagttaagcaagcgcgtgatttaggtatctctaaaccggttcttgggcctgatggttttgatagtccgaaatttgtgcaatcggcaacacctgtaggagcttcaaacgtttattatttgacaggtttcactacacaaggatcaaccaaagctaaagctttccatgatcattacgttaaggcatatggtgaagaaccatccatgttctcggctttatcatacgacgctgtgtatatggcagctaaatctgctaaaggagctaaaacttcaattgatattaaaaaagctttagctaagctgaaagattttaaaggtgtgacagggaaaatgtctattgataaaaatcacaatgttgttaaatcagcttacgttgtcaaattagaggatggaaaaacaagtagcgttaacattatttcagcaaaa

SEQ ID NO: 9410 - protein, 388 aa, Streptococcus agalactiae
MEKRLSLGALVLASTVLLAACGNVGGGASSTGTKIGKDIKVGYNWELSGNVSSYGNSMKNGADLAVKEINAAGGVGGKKLKVLSQDNKSENAEAATVATNLVTKGANVIIGPATSGAAASSTPKVNAAAVPMIAPAATQDNLVYGSDGKTLNQYFFRATFVDNYQGKLLSQYATDNLKAKKVVLFYDNSSDYSKGVAKSFKESYSGKIVDSMTFSAGDTDFQASLTKLKGKEYDAIVMPGYYTETGLIVKQARDLGISKPVLGPDGFDSPKFVQSATPVGASNVYYLTGFTTQGSTKAKAFHDHYVKAYGEEPSMFSALSYDAVYMAAKSAKGAKTSIDIKKALAKLKDFKGVTGKMSIDKNHNVVKSAYVVKLEDGKTSSVNIISAK

SEQ ID NO: 9411 - DNA, 1350 bp, Streptococcus agalactiae
atggagaatcataattctattaaacagacctatggattaatgactacaattgctatgattgtaggtgtagtgattggttcaggcatttattttaaagttgatgacatccttaaatttactggtggagatgtctttttaggcatggtaattttagtactaggttctttttcgattgtttttggaagtttgtcaatttctgagctagctattagaacgagtgaaagtggtggtattttttcttactacgaaaaatatgttagcccagctttagcagcaactttaggcttgtttgcgtcttttttgtatcttccaactttaacagcaatcgtttcatgggtagctgcattttatactttaggtgaatcatcaagtttggaatcacagattattttagctgctgtttatattttagcgcttagtctcatgaatatctttgctaagcgtattgcagggggattccaatctttaacgacctttgtaaaaatgattcctttagttctaattgctttaattggtgctttttggtctgataaagctccacaacttccacaacatttaacagctattcaaccgtcaaatgttggatggagttgggtgtcaggtctggtaccattgtattttgcatatgatggttggacaatttttgttaatattgcaccagaagtcaagaatcccaagaagaatttaccacttgcctttgtcattggtccagcgcttatcttattatcatatttggcatttttctatggtttgacacaaattttaggtgctagctttattatgacaaccggtaatgatgctattaattatgcagctaatattattttcggtcctagtgttgggcgtttattatctttcattgttattctatctgtattaggtgttgccaatggacttttacttgggacgatgcgtctacctcaagcttttgcggaacgcggatggatcaaaagtgagaggatggctaacataaatttgaagtatcaaatgtcattgccagctagtttgacggtgacggctgtagctattttttggctttttgttcattttatggttacaaaatttaacttattgccgggtagtgatattagtgaaattgctgtggtgtttaataataccagtttaatcattctttatgttttagtactcagcctttatctcaaaaaagatattaaaaataaatttaccggcttagtttcaccgattctagcaattttaggcggtttgatcctccttatcgggagtttgttaagtaatttctttacggttttaattttccaatgtttttgcttattattctgtttgatttgtcattatatctatcaaaaaaataacccaaaaactcatgaa

SEQ ID NO: 9412 - protein, 450 aa, Streptococcus agalactiae
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTFVKMIPLVLIALIGAFWSDKAPQLPQHLTAIQPSNVGWSWVSGLVPLYFAYDGWTIFVNIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKNKFTGLVSPILAILGGLILLIGSLLSNFFTVLIFQCFCLLFCLICHYIYQKNNPKTHE

SEQ ID NO: 9413 - DNA, 741 bp, Streptococcus agalactiae
atgactactattataacttcaaaatcaaataatctcattaaaaaaacgaaaaagttgttacaaaaaaaatatcggaaatcttcatatcttattgaaggctggcatttatttgaggaagctgaaaaatatggtgcacaatttttaaatatttttgtgacagaaacggcaatagatcgtttgagaaaacccgagagagctattgttgttacagatgatgttttgaaagaattaactgactcacagactcctcaagggattgtagctgagattgcctttcaagagacaagatggacagatattaaaaaaggacgttttcttgtattagaagatgtgcaggatccaggaaacctaggaacaatggttcgaactgcagatgcagcgaattttgatgctgtttttttatctcagaaatctgctgatttgtataaccaaaaaacacttcgttctatgcaaggcagtcactttcatttaccagtatttagggtagaaatagagcagtttgttaacttttgtaaagcagaagggataactatgattgcgacaactttatctgaacaatcggtaaattataagaatctccctaaatatgattattttgctttaatcatgggaaatgagggacagggaatttccaaaactatgacagaagaagcagatgttttagcacatattgaaatgcctggacaagcagaaagtcttaatgtagcagtagctgcgggagtagtcattttcagcttaatt

SEQ ID NO: 9414 - protein, 247 aa, Streptococcus agalactiae
MTTIITSKSNNLIKKTKKLLQKKYRKSSYLIEGWHLFEEAEKYGAQFLNIFVTETAIDRLRKPERAIVVTDDVLKELTDSQTPQGIVAEIAFQETRWTDIKKGRFLVLEDVQDPGNLGTMVRTADAANFDAVFLSQKSADLYNQKTLRSMQGSHFHLPVFRVEIEQFVNFCKAEGITMIATTLSEQSVNYKNLPKYDYFALIMGNEGQGISKTMTEEADVLAHIEMPGQAESLNVAVAAGVVIFSLI

SEQ ID NO: 9415 - DNA, 1206 bp, Streptococcus agalactiae
atgaaacgatttttaaaagcttggagaaaaacaagcttgataaaaaaaataacaattggagtcgttattggcttattcttgggtattttagtccctaaagcctctgcgattggtttacttggtcaactttttgtaggagggttgaaagctattgcccctcttttagttttcactttagttattagtgccttgtcgcaacaccgtgagggcggtaagaccaatatgtcaacgataattggtttgtatatcactgcaacttttgcagcggccctaatcgctgttgttgtgaactatattttccctttgacactgatattgaaaacgccagcaaagacagacttattacctcccaaggggatttcagaagtctttcaatctcttttgttgaaaattgttgataatcccattcatgccattaccgaggccaattatatgagtattctattttgggcggttatttttggtttggcgatgcgaagcagtaatcagcgtacaaaagatttaatgcaaacttttgctgatgctacttcacaagttgtcaaatggattatcaatttggccccaattggtattatggggttggttttcactagcatttcagaaaacggtattggtatactaggtgattatggtcttttaatattagttttggtgggtacgatgttatttgtagctcttgtcgttaacccaatcattgcttttgttatgatgcgtaaaaatccttaccctttggtattacgatgcttaaaggattcaggtattacagctttctttacacgtagttctgcggcgaatattcctgttaatatgagactatgtgaggatttaggattagataaagacacttactcagtatctatcccgcttggtgcagctatcaatatggctggtgcagctattacaattaatatcctgactttagcagcagtaaatactttaggaattactgttgattttccaacagcattcttattaagtgtggttgctgctgtatcagcatgtggagcttctggtgtaactggtggttcacttttattgattccggtggcatgtagcttatttggtatttcaaatgacgttgcaatgcaagtcgtaggagttggtttcattgtaggggtgatacaggattcgtgtgagacagccttaaattcatcgacagacgttctgttcacggctgtagctgaaaaatcagtttttggaaaaaaa

SEQ ID NO: 9416 - protein, 402 aa, Streptococcus agalactiae
MKRFLKAWRKTSLIKKITIGVVIGLFLGILVPKASAIGLLGQLFVGGLKAIAPLLVFTLVISALSQHREGGKTNMSTIIGLYITATFAAALIAVVVNYIFPLTLILKTPAKTDLLPPKGISEVFQSLLLKIVDNPIHAITEANYMSILFWAVIFGLAMRSSNQRTKDLMQTFADATSQVVKWIINLAPIGIMGLVFTSISENGIGILGDYGLLILVLVGTMLFVALVVNPIIAFVMMRKNPYPLVLRCLKDSGITAFFTRSSAANIPVNMRLCEDLGLDKDTYSVSIPLGAAINMAGAAITINILTLAAVNTLGITVDFPTAFLLSVVAAVSACGASGVTGGSLLLIPVACSLFGISNDVAMQVVGVGFIVGVIQDSCETALNSSTDVLFTAVAEKSVFGKK

SEQ ID NO: 9417 - DNA, 1368 bp, Streptococcus agalactiae
ttgatgaaactaaaaaacacttatatcattatcggcttgatgctttttgcgctgttctttggagccggtaatcttatttatccagcctacttaggtatctactctggttctaattgggcgtgggctatcattgggttctgcttaacaggcgtaactttacccctacttggtgttgcagctgtggcgtactcaggagcaaccgatgttgaaagcttcaccaaacctgtctctaaaacatatgctattttctttgcagtagcactatacctatctattggacctttctttgccattcctcgaacaggggcaacctcattctcagttggtattcaacctatcttaggcgacagctccttagtcaaaattatctatggtttaattttctttggtatttcttatttcttagctattagacctagtcagattgtagatcgtattggtaaatatctaactccctttttactaactgttattagtattttaattattgcctcactcatccatccagctgctatcgttggaacaccacataacgcttcaacgaatgtcagcgatgctttcaaggatttaccattcctagcaggactgattcaggggtatggtacaatggatgcccttgcatcaattgcttttgctattatcgttattcaagcaagtaaacagtacggagcaattaccaaaaaagaaattacttctatggcacttaaatctggtgctatcgctacatttcttttagcttttatttatatttttgtaggacgtattggtgcaacttcacaaagcttgtttaaatttgcaaatggttccttcttacttcacaatactccaatagacggtgggcatgttcttagtcaatcagctaacttctatttaggaattgtgggacaagctattttaggtacggctatttttcttgcttgcttaacaacagctactggattaatcactgcttgtgcggaatacttccacaaattacttccaaagattagtcacattacttgggctacaatctttactttaattgctattacgttctattttggtggtttatcagagattatccgttggtcactaccagttctctaccttctctatccattaactatagtcttaattttcttagtcttttttgatcaaaaatttgaaagtagccgcattgtctaccaaacttctattgccgccactgctgtcgctgctttatacgatgccttatcaaaactcggcgaaatgactggtttatttaccattccatccgctttgaccacattctttactaaagttgttcctttaggtgaatattctatgggatggattagttttgcaatttgtggtgtcttagttggtcttattctaaaaaaagtaaaagca

SEQ ID NO: 9418 - protein, 456 aa, Streptococcus agalactiae
MMKLKNTYIIIGLMLFALFFGAGNLIYPAYLGIYSGSNWAWAIIGFCLTGVTLPLLGVAAVAYSGATDVESFTKPVSKTYAIFFAVALYLSIGPFFAIPRTGATSFSVGIQPILGDSSLVKIIYGLIFFGISYFLAIRPSQIVDRIGKYLTPFLLTVISILIIASLIHPAAIVGTPHNASTNVSDAFKDLPFLAGLIQGYGTMDALASIAFAIIVIQASKQYGAITKKEITSMALKSGAIATFLLAFIYIFVGRIGATSQSLFKFANGSFLLHNTPIDGGHVLSQSANFYLGIVGQAILGTAIFLACLTTATGLITACAEYFHKLLPKISHITWATIFTLIAITFYFGGLSEIIRWSLPVLYLLYPLTIVLIFLVFFDQKFESSRIVYQTSIAATAVAALYDALSKLGEMTGLFTIPSALTTFFTKVVPLGEYSMGWISFAICGVLVGLILKKVKA

SEQ ID NO: 9419 - DNA, 1053 bp, Streptococcus agalactiae
atgagagctgcaacttatctttcagctaatgaattatcacttactgataaggctaaacctcaagtaataaaacccacagatgcggttgtaagacttgtcaaaacaaccatttgtggtactgatctacatatccttggtggcgatgttcctgcttgtaaaccaggaacaactttaggtcatgaaggcattggtatcgtcgaagaagttggttctgctgtcaatcattttaaagtcggagataaagtaattatttcttgtgtcactgcctgtaatacttgctattactgtaagcaccagttgccttcacattgtgaagatggcgggtggattttaggacatcttattgaaggtactcaagcagaatatgttcatattccacatgcagatggtagcctttatcatgcacctgaaggtgtttgtgacgatgcattggttatgttatctgatattttaccaacttcatacgaaatcggcgtcttaccttctcacattaaaccaggtgatactgtttgtattgtaggcgctggaccaattggactatctgccttactaactgcacaattctattctcctgccaaaattattatggttgatttatctcaaaaacgacttgaagcctctaaaaaatttggtgcaacacacaccattctatcaacgtctactcaagaagttaaagaagaaattgataaaattaccaaaggccgtggcgttgatgtcgtattagaatgtgttggttatcctgcaacatttgatatttgtcaaaatgtagtttctattggaggacatatcgcaaatgttggtgttcatggtaaacctgttgaatttaacctccaagatttatggataaaaaatataacccttaatactggattagttaatgctaatacaactgaaatgctccttgaagttcttgagacaggcaaaatcgatgcaacacaactagtaacacatcacttcaagctatctgaaatcgaagaagcttataaggtatttaaagctgctgaagaaaacaatactctcaaagttatcatcgaaaacgatattactccagcc

SEQ ID NO: 9420 - protein, 351 aa, Streptococcus agalactiae
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 9421 - DNA, 1128 bp, Streptococcus agalactiae
atgagggcaaatggtgaaaagatattgcggttaaatactggaaatccagctgcctttggcttcgaagcgccagatgaagtcattcgtgatttaattacgaatgcgcgtgaatcagaaggttactctgattcgaaaggtattttttcagctcgtaaggctgttatgcagtattaccagttacaaaacatccatgttgacatggatgatatatacattgttaatggtgttagtgagggaatctctatgtcaatgcaagctttgcttgataatgatgacgaggttctagttccaatgccagattacccgttatggacagcttgtgttagccttgctggtggaaatgctgtgcattatatttgtgatgaggaagctaattggtatcctgatattgatgatatcaaatcaaaaatcacatccaaaacaaaagcaattgtcctcattaatccaaataatccaactggagcagtctatccgcgtgaaattctgcaagagattgtggatatcgctagacaaaatgacttgattattttttcagacgaggtttatgaccgtttagttatggatggaatggagcatatcccaattgcttctattgcagaggatatttttacagttactttatctggcttatctaaatcacatcgcatctgtggtttccgcgttggttggatggtattgtctggtccgcgacaacatgttaaaggttatattgaaggtttgaatatgttagctaacatgaggctgtgttcaaatgttcttgctcaacaggttattcaaacatcgttaggcggacagcaatctattgatagtatgttgttgccaggaggtcgtatctacgagcaacgtaattatatccataaagcaattaatgaaatacctggtttatctgctgtaaaaccaaatgctggactgtatcttttccctaaaattgatacagatatgtaccgtattgataatgatgaagagtttgtgcttaatttcttaaaacaagaaaaagtattactaacacacggtagaggatttaatatgaataccgctgaccattttagaattgtttacttaccacgtgttgatgaattgactgaactacaagaaaaaatggctcgctttttaagccaatacaagcgc

SEQ ID NO: 9422 - protein, 376 aa, Streptococcus agalactiae
MRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 9423 - DNA, 285 bp, Streptococcus agalactiae
atggctaaatacgaaattctttatattattcgtccaaacattgaagaagaagctaaaaacgctttggtagcacgttttgattctatcttatctgacaacggtgcaactgttgttgaatcaaaagattgggaaaaacgtcgtcttgcatacgaaatccaagatttcactgaaggactttaccatatcgttaacgttgaagctgaagatgcagtagctcttaatgagtttgatcgtctttcaaaaatcaacggtgacattcttcgtcacatgatcgttaaagtagac

SEQ ID NO: 9424 - protein, 95 aa, Streptococcus agalactiae
MAKYEILYIIRPNIEEEAKNALVARFDSILSDNGATVVESKDWEKRRLAYEIQDFTEGLYHIVNVEAEDAVALNEFDRLSKINGDILRHMIVKVD

SEQ ID NO: 9425 - DNA, 1122 bp, Streptococcus agalactiae
atgtggcctgaagatagaatcgcttcttttcgtcgcacacttttagggtggtatgaccaagaaaaacgtgatctcccttggcgaagaactactaatccatactatatttgggtttctgaaatcatgttgcaacaaacacaagttaatacagtaatcccttattataaacgttttctagagtggtttcctcaaataaaagatttggcagacgctcctgaagaacaattactaaaggcatgggagggactaggctattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgctgttgatggcaatgtgatgcgtgtcatggctcgtttgtttgaagttaattatgacatcggtgaccctaaaaatcgtaaaatttttcaagctattatggaaatactaattgaccctgacagacccggtgattttaaccaagcacttatggatctgggtacagacatcgaatccgctaagacacctagacctgatgaaagccctattcgtttctttaatgctgcttatttgaatggtacttatagtaaatatcccataaaaaatactaagaaaaagcctaaaccaatgcgaattcaggcttttgtcattcgtaaccaaaatggtcaatatctactggagaaaaatactaaagggagacttctagggggtttttggtcatttcctattatcgaaacgtcacctctttctcaacaattagatttatttgatgacaatcaatccaaccccataatctggcaaacccaaaatgaaactttccaaagagaatatcaattaaagccccaatggactgataatcactttccaaatattaagcacacttttagtcaccagaagtggacaatagaactcatagagggggtggtcaaagcaacagatttacctaatgctcctcacctaaagtgggtagcaattgaggacttttctctgtatccctttgcaacaccacaaaagaaaatgctagagacctacttaaaacagaaaaatgct

SEQ ID NO: 9426 - protein, 374 aa, Streptococcus agalactiae
MWPEDRIASFRRTLLGWYDQEKRDLPWRRTTNPYYIWVSEIMLQQTQVNTVIPYYKRFLEWFPQIKDLADAPEEQLLKAWEGLGYYSRVRNMQKAAQQVMVDFGGIFPHTYDDIASLKGIGPYTAGAIASISFNLPEPAVDGNVMRVMARLFEVNYDIGDPKNRKIFQAIMEILIDPDRPGDFNQALMDLGTDIESAKTPRPDESPIRFFNAAYLNGTYSKYPIKNTKKKPKPMRIQAFVIRNQNGQYLLEKNTKGRLLGGFWSFPIIETSPLSQQLDLFDDNQSNPIIWQTQNETFQREYQLKPQWTDNHFPNIKHTFSHQKWTIELIEGVVKATDLPNAPHLKWVAIEDFSLYPFATPQKKMLETYLKQKNA

SEQ ID NO: 9427 - DNA, 867 bp, Streptococcus agalactiae
atgaagactacaaaagttttttcagttttatcgttatctgttgctgtatttatgatgacagcatgtcagtcaaaccacagtactaaaaaagctgatatgtctccagataaggtggagcaaaagacgaaatttaaaaatatttctctaagttctaataaactgttggctaaggaaaacactatgtctgtcctttggtatcaaaattctgcagaagccaaggctttatatttacaaggttataatgttgctaaaatgaagttagatgattggttacaaaagcccagtgaaaaaccatattcaattatcttagatttagatgaaacagttttagataatagcccatatcaagcaaagaatattaaagatggctctagtttcacgccagagagttgggataaatgggtgcaaaagaaatcagctaaggctgttgcgggtgccaaagaatttttgaagtatgctaatgaaaagggaataaaaatttattatgtctcagatcgtacagatgctcaagttgatgcgactaaagaaaatttagagaaggaaggtatacctgttcaagggaaagaccacttgcttttccttaaaaaaggaatgaaatctaaagagagtcgccgtcaggcagttcaaaaagataccaatttaattatgctttttggagataatttagttgattttgctgatttttctaaatcatctagtacagatagagaacaactactaactaaacttcaaagtgagtttggtagtaaatttattgttttcccaaatcctatgtacggttcttgggaaagtgctatttatcaaggaaaacatctggatgttcaaaaacaattgaaagaacgacaaaaaatgttgcattcgtatgat

SEQ ID NO: 9428 - protein, 289 aa, Streptococcus agalactiae
MKTTKVFSVLSLSVAVFMMTACQSNHSTKKADMSPDKVEQKTKFKNISLSSNKLLAKENTMSVLWYQNSAEAKALYLQGYNVAKMKLDDWLQKPSEKPYSIILDLDETVLDNSPYQAKNIKDGSSFTPESWDKWVQKKSAKAVAGAKEFLKYANEKGIKIYYVSDRTDAQVDATKENLEKEGIPVQGKDHLLFLKKGMKSKESRRQAVQKDTNLIMLFGDNLVDFADFSKSSSTDREQLLTKLQSEFGSKFIVFPNPMYGSWESAIYQGKHLDVQKQLKERQKMLHSYD

SEQ ID NO: 9429 - DNA, 411 bp, Streptococcus agalactiae
atgcctacaattaaccagttggtacgtaaaccacgtaaatctaaagttgaaaaatcagattcacctgctttgaatattggttacaacagtcacagaaaagttcacactaaattatctgcaccacaaaaacgtggtgttgcaactcgtgttggaactatgacacctaaaaaacctaactctgcccttcgtaaatttgctcgtgtacgtttgagcaaccttattgaagttactgcttacattccaggtatcggacacaacttgcaagaacacagtgttgtgcttatccgtggtggacgtgtaaaagaccttccaggggtacgttaccatatcgttcgtggtgcacttgatactgcaggtgtagctgatcgtaaacaaggccgttctaaatacggtgctaaacgtcctaaaggg

SEQ ID NO: 9430 - protein, 137 aa, Streptococcus agalactiae
MPTINQLVRKPRKSKVEKSDSPALNIGYNSHRKVHTKLSAPQKRGVATRVGTMTPKKPNSALRKFARVRLSNLIEVTAYIPGIGHNLQEHSVVLIRGGRVKDLPGVRYHIVRGALDTAGVADRKQGRSKYGAKRPKG

SEQ ID NO: 9431 - DNA, 1353 bp, Streptococcus agalactiae
atgaaaaaagaaagtatatctattaaagatatcttgtggtttattattccgtcgttatttggagtattattattaatgactccatttaaatataatggtatgacaacagtagctgtctctgtaatctctaagacaattaatcaatggattaacgctgtttttcctatacattatattattttactaatcatttttatttcatgtgtgttagcactttgttatcgtctgtttagacctagctttattgaaaaaaatgacttgctaaaagaaatttctgacattaccattttctggctgattattcgtttgatcggtttggcacttggtctgatgacggttttacatattggtcctgaaatggtatgggggaaagagacaggcggccttatcctttttgatttgattggtggtttgtttaccattttccttgctgcgggttttattcttccatttttgacagaatttggtctactggagtttgttggtgtcttcctaactcccattatgcgtccattctttcagctacctggtcggtcagcagttaattgtgtagcctcatttgtaggtgatggtactattggaattgctttgaccgataagcagtatgttgagggttattataccagtagagaagctgcaacgatttccactactttttcagcagtatcaatcactttttgtcttgttgttttgcagaatgttggcttaactgattattttggccatttttatctaacagtcatcattagcagtgttgtctgtgcattcattatcccttatatccctcccttatctcgtcaatcaaatagttattacactaaaccaaagaaagaaacatctgaggtaattccggatggttataacaagatagagtggggacttaagcttgccatcgataaatcaaaagcaaatggaaacatgaagacttttgtcaataatgcctctaagacagtacttagtttatggtttggcgttatgccaacaattatgactgtcggaacaatagctttgattatttcagtatcaacacctatttttaaaattttaggtacaccattccttccgttccttgaacttttagggattccagaagcagatattgcgagtcaaaccatgattgttggtttttcagatatggttgttccttcgataatggcggctgaaattcacagtgagatgacaagatttattgtcgcaacagtttctattgtgcaattaatttatatgtctgagactggtgcggtgatattaggttccaagatccctatcaacattctagaattatttatcatttttatagagagaacaattatttcattacctattattgttttgatggcacatcttttcttt

SEQ ID NO: 9432 - protein, 451 aa, Streptococcus agalactiae
MKKESISIKDILWFIIPSLFGVLLLMTPFKYNGMTTVAVSVISKTINQWINAVFPIHYIILLIIFISCVLALCYRLFRPSFIEKNDLLKEISDITIFWLIIRLIGLALGLMTVLHIGPEMVWGKETGGLILFDLIGGLFTIFLAAGFILPFLTEFGLLEFVGVFLTPIMRPFFQLPGRSAVNCVASFVGDGTIGIALTDKQYVEGYYTSREAATISTTFSAVSITFCLVVLQNVGLTDYFGHFYLTVIISSVVCAFIIPYIPPLSRQSNSYYTKPKKETSEVIPDGYNKIEWGLKLAIDKSKANGNMKTFVNNASKTVLSLWFGVMPTIMTVGTIALIISVSTPIFKILGTPFLPFLELLGIPEADIASQTMIVGFSDMVVPSIMAAEIHSEMTRFIVATVSIVQLIYMSETGAVILGSKIPINILELFIIFIERTIISLPIIVLMAHLFF

SEQ ID NO: 9433 - DNA, 951 bp, Streptococcus agalactiae
atgaaaaaattaacaaaaggcagccacattcgtgttcttagtccctcttcttccattgagcgtctgggtggttttgaggctaacctattagccaaagaagtactagaaaagctgggatttcaagtgtcattctctaagcactatctagaaaatgatatcctctattctgcttcgattactagccgtgtagaagatttacatgaagcatttgccgacccttctgttgatgccatattagcaaccattggcggattcaattccaacgagcttttaccatatttagattatgatttaatctctaagaatcccaaaataatttgtggttactcagattcaacggccttccttaatgctatttttgccaaagcaaaaatccaaacttacatgggccctgcttattcttctttcaaaatgaaggaaggtcaaccttaccaaacacaagcttggcttactgccatgacagaaaaccactatgaactttggcctagtgaagaatggtctagtgatccctggtatgatcccagcaaaccacgccaatttttcccaacagaatggaaaatttataatcacggaaaagcttccggtacgattatcggaggtaatctctctacgtttggcctacttcgaggtactccttatgcaccgaaaattgaacgctatgtcctcttgattgaagaggctgaggaaagtaatttttatgaatttgaccgcaaccttgctgcaattttacaagcttatcctcatccacaagctattcttatggggcgctttcctaaagaatgcggcatgactccacaagtctttgaatatatcctttcaaaacatgctattttcaaggaaattcctgttatttatgatatggattttgcgcacacccaacctcttttgacagtgactattggagctgagctaagcgttgacactactacattatctctatctataaaagaa

SEQ ID NO: 9434 - protein, 317 aa, Streptococcus agalactiae
MKKLTKGSHIRVLSPSSSIERLGGFEANLLAKEVLEKLGFQVSFSKHYLENDILYSASITSRVEDLHEAFADPSVDAILATIGGFNSNELLPYLDYDLISKNPKIICGYSDSTAFLNAIFAKAKIQTYMGPAYSSFKMKEGQPYQTQAWLTAMTENHYELWPSEEWSSDPWYDPSKPRQFFPTEWKIYNHGKASGTIIGGNLSTFGLLRGTPYAPKIERYVLLIEEAEESNFYEFDRNLAAILQAYPHPQAILMGRFPKECGMTPQVFEYILSKHAIFKEIPVIYDMDFAHTQPLLTVTIGAELSVDTTTLSLSIKE

SEQ ID NO: 9435 - DNA, 750 bp, Streptococcus agalactiae
atgtttatatttaaaagaaaaaaacaagtagaaatgcctttggagaaaataccagcacatattggtattatcatggatggtaacggacgttgggcaaaaaaacgtttaaaaccacgcgttatgggacataaggcggggatggatgctcttcaagaagttacaatagcagcttcaggattaggtgttaaagtactaactgtctatgccttttctacagaaaattggtcacgtccagatgatgaagttaagtttattatgaaccttccggttaaattttttgataaatatgtaccagagttagataaaaataatgtacgtgtacaggtcatcggagatactcataaattacctaaggcaacatacgatgcaatgcaacgcgcttgtttgaggacaaaacataattcggggctcgtcttgaattttgcgctaaattatggcggacgttcagaaatcactaatgccattaaggaaattgctcaggatgttttggaagctaagttgaatcctgacgatattacagaggatttagtagcaaatcatttaatgacaaatagcttaccctatctttatagagaccctgatttgattatccgaactagtggagagttacgcttgagtaactttttaccttggcaatcagcttatagtgaattttactttactcccgttttatggccagattttaaaaaagacgaactacataaggccattgtggattataatcaacgccatcgtcgatttggtagtgta

SEQ ID NO: 9436 - protein, 250 aa, Streptococcus agalactiae
MFIFKRKKQVEMPLEKIPAHIGIIMDGNGRWAKKRLKPRVMGHKAGMDALQEVTIAASGLGVKVLTVYAFSTENWSRPDDEVKFIMNLPVKFFDKYVPELDKNNVRVQVIGDTHKLPKATYDAMQRACLRTKHNSGLVLNFALNYGGRSEITNAIKEIAQDVLEAKLNPDDITEDLVANHLMTNSLPYLYRDPDLIIRTSGELRLSNFLPWQSAYSEFYFTPVLWPDFKKDELHKAIVDYNQRHRRFGSV

SEQ ID NO: 9437 - DNA, 339 bp, Streptococcus agalactiae
atgagcttacctattattatgcttgttgttatggttggtatgatgttcttcatgcaacgtcagcaaaagaaacaagcacaagaacgtcaaaaacaattgaatgctgttcaaaaaggtgatgaaattgtcacaattggtggtctttttggagtagttgatgaagttaatactgaagcacaacgaatggttttagatgttgatggtgtctatttgacgtttgagttggcagctatcaaatctgttgtctctaaggcagcaacaccaacagaaccagttgaagatgttaagattattgaagtcaatgaagacgaaaataaagaaacagccatcgaaactgaa

SEQ ID NO: 9438 - protein, 113 aa, Streptococcus agalactiae
MSLPIIMLVVMVGMMFFMQRQQKKQAQERQKQLNAVQKGDEIVTIGGLFGVVDEVNTEAQRMVLDVDGVYLTFELAAIKSVVSKAATPTEPVEDVKIIEVNEDENKETAIETE

SEQ ID NO: 9439 - DNA, 282 bp, Streptococcus agalactiae
atgttaaaaccattaggtgatcgtgtgatcatttcgtttgttgaaactgaagagaaatctgtcggtggttttgttcttgcaggagcaagccatgatgcgacaaagacagccaaagttcttgctgtgggtgacggtattcgtaccttaacaggggaattagttgcaccgagcgttgcagagggtgatactgttttagtcgaaaatggtgctggtctggaagttaaagacggtaacgaaaaagtgacagttgttcgcgaaagtgacattgttgctgtcgttaaa

SEQ ID NO: 9440 - protein, 94 aa, Streptococcus agalactiae
MLKPLGDRVIISFVETEEKSVGGFVLAGASHDATKTAKVLAVGDGIRTLTGELVAPSVAEGDTVLVENGAGLEVKDGNEKVTVVRESDIVAVVK

SEQ ID NO: 9441 - DNA, 354 bp, Streptococcus agalactiae
atgtctactttaacaataattattgcaacattaactgctttggaacatttttatattatgtatttggagacgttagccacccagtcaaatatgactgggaagatttttagtatgtctaaagaagagttgtcatatttacccgttattaaactttttaagaatcaaggtgtatacaacggcttgattggcctattcctcctttatgggttatatatttcacagaatcaagaaattgtagctgtttttttaatcaatgtattgctagttgctatttatggtgctttgacagttgataaaaaaatcttattaaaacagggtggtttacctatattagctcttttaacattcttattt

SEQ ID NO: 9442 - protein, 118 aa, Streptococcus agalactiae
MSTLTIIIATLTALEHFYIMYLETLATQSNMTGKIFSMSKEELSYLPVIKLFKNQGVYNGLIGLFLLYGLYISQNQEIVAVFLINVLLVAIYGALTVDKKILLKQGGLPILALLTFLF

SEQ ID NO: 9443 - DNA, 870 bp, Streptococcus agalactiae
atgtctaaaaaaattaagaattttatactattaaatattggatctctaattgttgcatttggtttcaacgctttctttcttcataatcatattgtcacgggggggattagtggtttggcagttagttttcatgaagtatttggttgggattctgctttttttattatgattatcaatattccattgctccttctttgctactttggcttaggtaaacaaacctttttaaaaactgtctatggttcttggatttttcctgtttttattaagttaacacaaagtgtaccaactttgacccacaacccactcctcgcagcactttttggaggtgttattgtaggatgtggtttggggattgttttttggagcgactcttcaactggtggaacggggattatcattcaattcttaggaaaatatactcctataagccttggacaaggggttatattgattgatggacttgttacaattgttggtttcctagcttttgacagtgatacggttatgttttctattattgggttgataactattagttatattattaatgctatccaaactggatttacaaccttaagcactgtcttaatcgtttctcaagagcaccaaaaaattaagacatatatcaatactgtcgcagatagaggagtaacagaaattcccgttaaagggggatattctggaactaatcaaatcatgcttatgacaactattgctggttatgagtttgctaaattacaagaggcaatagcagaaattgacgaaacagccttcataacagtaactccaacatcacaagcttctggacgtggatttagtcttcaaaaaaatcatggacgtcttgatgaagacattcttatgccaatg

SEQ ID NO: 9444 - protein, 290 aa, Streptococcus agalactiae
MSKKIKNFILLNIGSLIVAFGFNAFFLHNHIVTGGISGLAVSFHEVFGWDSAFFIMIINIPLLLLCYFGLGKQTFLKTVYGSWIFPVFIKLTQSVPTLTHNPLLAALFGGVIVGCGLGIVFWSDSSTGGTGIIIQFLGKYTPISLGQGVILIDGLVTIVGFLAFDSDTVMFSIIGLITISYIINAIQTGFTTLSTVLIVSQEHQKIKTYINTVADRGVTEIPVKGGYSGTNQIMLMTTIAGYEFAKLQEAIAEIDETAFITVTPTSQASGRGFSLQKNHGRLDEDILMPM

SEQ ID NO: 9445 - DNA, 1227 bp, Streptococcus agalactiae; identical to SEQ ID NO: 8873

SEQ ID NO: 9446 - protein, 409 aa, Streptococcus agalactiae
MKKKLVSSLLKCSLIIIVSFAGGAFASFVMNHNDNIPNGGVTKTSKVNYNNITPTTKAVKKVQNSVVSVINYKQQESRSDLSDFYSHFFGNQGGNTDKGLQVYGEGSGVIYKKDGKNAYVVTNNHVIDGAKQIEIQLADGSKAVGKLVGSDTYSDLAVVKIPSDKVSNIAEFADSSKLNIGETAIAIGSPLGTEYANSVTQGIVSSLKRTVTMTNEEGQTVSTNAIQTDAAINPGNSGGALINIEGQVIGINSSKISSTSNQTSGQSSGNSVEGMGFAIPSNDVVKIINQLESNGQVERPALGISMAGLSNLPSDVISKLKIPSNVTNGIVVASIQSGMPAQGKLKKYDVITKVDDKEVVSPSDLQSLLYGHQVGDSITVTFYRGENKQTVTIKLTKTSKDLAKQRANN

SEQ ID NO: 9447 - DNA, 966 bp, Streptococcus agalactiae
atgtcttattctaatttaaaattgtttgcactgtcatcaaacaaagaactagcgaaaaaagtgtctcagacgattggaattccgctaggtcaatcgacagttcgccaattttctgatggtgagattcaagttaatattgaagagtctattcgtggccatcatgtttttattttacaatcaacaagctcaccagttaatgataatttgatggaaattttaattatggttgacgctttaaagcgtgctagtgcggagtctgttagtgtggtaatgccttactatgggtatgctcgtcaagatcgcaaggcacgttctcgtgaacctattacttcgaaactcgttgcgaacatgctagaagttgctggtgttgatcgtcttttaacagttgatttacatgcagctcaaattcagggattctttgatattcccgttgatcaccttatgggggctccccttattgcagattactttgatcgtcagggattggttggtgatgatgttgttgtcgttagtcctgatcatggtggcgtaacacgtgcacgtaagctggcacagtgtttaaagacaccgattgctatcattgataagcgccgtagtgttactaaaatgaatacatctgaagtaatgaatattattggtaatatcaaaggtaaaaaatgtattttaattgatgatatgattgatactgcaggtactatttgccatgctgcagacgctttagctgaagcaggggcaacagcggtttatgcttcatgtactcaccctgttttatcagggccggctttggataatattcaaaattcagctattgaaaaattaattgtgttagatacgatttacctccctgaagaacgtttgattgataagattgaacaaatttcaattgcggaattgattggtgaagctattatccgtattcacgagaaacgtcctttatcaccattatttgaaatgaataaactaaaa

SEQ ID NO: 9448 - protein, 322 aa, Streptococcus agalactiae
MSYSNLKLFALSSNKELAKKVSQTIGIPLGQSTVRQFSDGEIQVNIEESIRGHHVFILQSTSSPVNDNLMEILIMVDALKRASAESVSVVMPYYGYARQDRKARSREPITSKLVANMLEVAGVDRLLTVDLHAAQIQGFFDIPVDHLMGAPLIADYFDRQGLVGDDVVVVSPDHGGVTRARKLAQCLKTPIAIIDKRRSVTKMNTSEVMNIIGNIKGKKCILIDDMIDTAGTICHAADALAEAGATAVYASCTHPVLSGPALDNIQNSAIEKLIVLDTIYLPEERLIDKIEQISIAELIGEAIIRIHEKRPLSPLFEMNKLK

SEQ ID NO: 9449 - DNA, 1173 bp, Streptococcus agalactiae
atgacattagagaaacgatttaataagtacttagatagaatagaggtctccttaattcgtcagtttgatcaatctatttcagatatacctggaatggtaaaattaactcttggagaaccagattttaccactcctgatcatgttaaagaagcagctaaatcagctattgatgcgaatcaatcgtattacactggtatgagcggtttattagctctaaggcaagctgctgcagattttgcaaaggataaatataatcttacttataatcctgattgtgagatcttggttacgataggtgccacagaagctctgtctgcatctcttatagctattttagaagctggtgatgttgttctattacctgcccccgcttatccaggatatgagccaatagttaaccttgtaggagctgatatcgtagaaattgatactagagaaaatgactttagactaactcctgaaatgttagaaacggctattatccaacaaggtgaaaaattaaaggctgttttacttaattatcctactaaccctacaggtattacctattcaaggcaagaaattgctgcattagctgaagtccttaaaaaatatgatatttttgttattagtgatgaagtttattctgagttaacttacactggtcagcagcatgtttcaattgcagaatatttacctaaccaaactatcttaattaatggcttatcaaaatcacatgctatgactggttggagagttggattggtgtatgctcctgaagcatttattgctcaaatcattaaaagtcatcaatacatggtgacagctgctagtactatttcgcaatttgctggggtagaagccttatctgtgggtaaaaatgatacgttacctatgcgtcaaggatatattaaacgtagagattatatcattgataaaatgtctaaacttggtttcaaaataattaaaccgagtggcgctttttatatctttgctaaaatacctgatagctatccacaggattctttcaagttttgtcaggattttgcttatcaacaagctgtagctattattccaggagtggcttttggtaaatatggtgaaggatatatacgtctttcttatgctgctagtatggaagttattgaaacagcaatggctagattgaaagtttttatggaatcatatgagggt

SEQ ID NO: 9450 - protein, 391 aa, Streptococcus agalactiae
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 9451 - DNA, 660 bp, Streptococcus agalactiae
atgttttttgtaaagcatgcttcaaagtcaaaattcaatgctgtgctccaacctttgactattgctcattttattttaaaaattaatgataatggtctttcttatattgatgattataaagaagttttagcatttcaagaaaccaattcagacttgtttaagttgtcatatgcgagttatattacttctttggctgatgtggctattagtgataatgtagcggatgctcaattatttattttcctaaagaaaacgttagaattgattgaggacggtttagattatgagattctaacgaatatttttgaagtacaactactagagaggttcggtgttgctttaaattttcatgattgtgttttttgtcatagggtaggattaccttttgatttttcacacaaatattctggattattatgtccaaaccattattataaagacgagagaagaaaccacctagatcctaatatgctgtacttaatcaatcgttttcagtcaattcaatttgatgatttacaaacaatttctgtgaaacctgagatgaaacttaaaattcgtcaatttttggacatgatttacgatgaatatgtagggattcatcttaaaagtaaaaaatttattgatgatttgtctagttggggaagtattatgaaatcagat

SEQ ID NO: 9452 - protein, 220 aa, Streptococcus agalactiae
MFFVKHASKSKFNAVLQPLTIAHFILKINDNGLSYIDDYKEVLAFQETNSDLFKLSYASYITSLADVAISDNVADAQLFIFLKKTLELIEDGLDYEILTNIFEVQLLERFGVALNFHDCVFCHRVGLPFDFSHKYSGLLCPNHYYKDERRNHLDPNMLYLINRFQSIQFDDLQTISVKPEMKLKIRQFLDMIYDEYVGIHLKSKKFIDDLSSWGSIMKSD

SEQ ID NO: 9453 - DNA, 849 bp, Streptococcus agalactiae
atgaaaaaaacattatacattaccaataaactcttttttgctaactggtttgtgccagttattggtgcagttctaattcaagttatcggcatcattgtaagtagacgccttgtagtaaaattgctacctgatgattataaattcaatttatacattgcgcttttactatttgttcctattttggcaagtattttactatttttaatctattttcaaaaaagggattttacttccttgggatttactaaagataataatgttttaacaacgatctcaggatttattactggtagtttactgatgttttttatttatatttgccactggttatcaggttttgtggaaatttcttccagcaattccttttcttttggaccttttttctttttatttcttgcatactttatccaaagcttgacagaggaaattttatttagaggatatgttatgacaacagttaccaaatttaaaggtagttttgcaggtgttttatgtaattctatgttgttttcttttatccactttagaaactatggtatcacagcaatagcactttttaatttatttttacttggtattattttttctattctttttaatatgaccaaaaatattctttttgttacaggagttcatactacatggaattttactatgggatgtgtattaggtaataaggttagtgggggggattctcctgtttctctttttagaattactgaaaattctagctttgctctttggaatggtggggattttggttttgaagggggagtactatgttctttgatattagtaggttgtttagcatacttttctttggaaagcgtgagagtatctgttagatat

SEQ ID NO: 9454 - protein, 283 aa, Streptococcus agalactiae
MKKTLYITNKLFFANWFVPVIGAVLIQVIGIIVSRRLVVKLLPDDYKFNLYIALLLFVPILASILLFLIYFQKRDFTSLGFTKDNNVLTTISGFITGSLLMFFIYICHWLSGFVEISSSNSFSFGPFFFLFLAYFIQSLTEEILFRGYVMTTVTKFKGSFAGVLCNSMLFSFIHFRNYGITAIALFNLFLLGIIFSILFNMTKNILFVTGVHTTWNFTMGCVLGNKVSGGDSPVSLFRITENSSFALWNGGDFGFEGGVLCSLILVGCLAYFSLESVRVSVRY

SEQ ID NO: 9455 - DNA, 990 bp, Streptococcus agalactiae
atgaagaaaattgctatagatgctatgggtggagattacgctcccaaagctattgtagagggtgttaatcaagctatttcagattttagtgatattgaagtacaactctatggcgatcagaaaaaaattgagaaatatttaacagtaacggagcgagttagtattattcatactgaagaaaaaattaattctgatgatgagcctgctaaagctgttcgtcgtaaaaaacagtcttcgatggtcttaggagctaaggcagtcaaagatggtgttgcacaggcctttatttctgcagggaatacaggagctttattagctgctggtttgtttgtagtaggacgtataaaaggtgttgatcgaccaggcttaatgtcaactatgcctacgttagatggtgtgggttttgatatgcttgatttaggagctaatgcagaaaacacagcttctcatcttcatcaatatgctattttagggtcgttttatgcaaaaaatgtccgtggtattgaagttcctcgtgtaggtctcttaaataacggaacggaagaaacaaaaggcgattctcttcataaagaagcttatgaactgttagcagcagagccttctattaattttattggaaatattgaagcacgtgatttgatgtctagtgtagcagatgttgttgtcactgatggttttactggaaatgctgttctaaagacaatggaaggtacagctatgagtattatgggaagcctaaaatcttcaattaaatcaggtggcgtgaaagctaaattaggagcacttctattaaaagatagcctatatcagctaaaagatagtatggactattcaagcgcgggtggagcggttctttttggtttaaaagctccaatagtaaaatgccatggatcaagtgattctaaagctgtttattctactttgaagcaagttcgtacaatgttggaaactcaagtagttgatcaattagttgatgcctttacagatgaa

SEQ ID NO: 9456 - protein, 330 aa, Streptococcus agalactiae
MKKIAIDAMGGDYAPKAIVEGVNQAISDFSDIEVQLYGDQKKIEKYLTVTERVSIIHTEEKINSDDEPAKAVRRKKQSSMVLGAKAVKDGVAQAFISAGNTGALLAAGLFVVGRIKGVDRPGLMSTMPTLDGVGFDMLDLGANAENTASHLHQYAILGSFYAKNVRGIEVPRVGLLNNGTEETKGDSLHKEAYELLAAEPSINFIGNIEARDLMSSVADVVVTDGFTGNAVLKTMEGTAMSIMGSLKSSIKSGGVKAKLGALLLKDSLYQLKDSMDYSSAGGAVLFGLKAPIVKCHGSSDSKAVYSTLKQVRTMLETQVVDQLVDAFTDE

SEQ ID NO: 9457 - DNA, 237 bp, Streptococcus agalactiae
atgtcaagagatgaagtttttgaaaagatgctggaattattaaggcagcaacttggtgacccacagttagatatcacaccagagtcatcgttacatgatgatttagcaattgactctatcgctttaacagagtttattatcaatttggaagatgtgtttcatctagagattccagatgaggctgtcgaacacatgtcaagcgtccaacaactattagattatatcattgaacataag

SEQ ID NO: 9458 - protein, 79 aa, Streptococcus agalactiae
MSRDEVFEKMLELLRQQLGDPQLDITPESSLHDDLAIDSIALTEFIINLEDVFHLEIPDEAVEHMSSVQQLLDYIIEHK

SEQ ID NO: 9459 - DNA, 588 bp, Streptococcus agalactiae
atgcctcttttagctttggcagctcaagaagcaggagcggttggtataagagccaatagtgtccgcgacattaaggaaattcaagaggttactaatttacctatcatcggcattattaaacgtgaatatcctccacaagaaccatttatcactgctacgatgacagaggtggatcaattagctagtttagatattgcagtaatagccttagattgtacacttagagagcgtcatgatggtttgagtgtagttgagtttattcaaaagataaaaaggaaatatcctgaacagttgttaatggctgatataagtacttttgaagaaggcaaaaatgcttttgaagcaggagttgattttgtgggtacaactctatctggatacacagattacagccgccaagaagaaggaccggatatagaactccttaataagctctgtcaagccggtatagatgtgattgcggaaggtaaaattcatactcctaagcaggctaatgaaattaatcatataggtgttgcaggaattgtagttggtggtgctatcactagaccaaaagaaatagcggagcgtttcatctcaggacttagt

SEQ ID NO: 9460 - protein, 196 aa, Streptococcus agalactiae
MPLLALAAQEAGAVGIRANSVRDIKEIQEVTNLPIIGIIKREYPPQEPFITATMTEVDQLASLDIAVIALDCTLRERHDGLSVVEFIQKIKRKYPEQLLMADISTFEEGKNAFEAGVDFVGTTLSGYTDYSRQEEGPDIELLNKLCQAGIDVIAEGKIHTPKQANEINHIGVAGIVVGGAITRPKEIAERFISGLS

SEQ ID NO: 9461 - DNA, 1089 bp, Streptococcus agalactiae
atgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttc

SEQ ID NO: 9462 - protein, 363 aa, Streptococcus agalactiae
MNSFKTIGIIGGGQLGQMMAIAAIYMGHKVITLDPASDCPASRVSEVIVAPYDDVEALGTLAARCDVLTYEFENVDADGLDAVVSAGQLPQGTDLLRISQNRIFEKDFLANKAGVTVAPYKVVTSSLDLEGLDLTKTYVLKTATGGYDGHGQKVIRSAEDLPEAQQLANSAQCVLEEFVNFDLEISVIVSGNGQDVTVFPVQENIHRNNILSKTIVPARISDQLADKAKEMAVQIAKKLQLSGTLCVEMFATADDIIVNEIAPRPHNSGHYSIEACDFSQFDTHILGVLGAPLPPIKLHAPAVMFNVLGQHVQQAIDHVAQNPSAHLHMYGKLEAKHNRKMGHVTVFSDVPDEVEEFEERMDF

SEQ ID NO: 9463 - DNA, 2640 bp, Streptococcus agalactiae
atgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaag

SEQ ID NO: 9464 - protein, 880 aa, Streptococcus agalactiae
MTEKTKAVETTDVALAIDTLVQNGLKALDEMRQLNQEQVDYIVAKASVAALDAHGELALHAVEETGRGVFEDKATKNLFACEHVVNNMRHTKTVGVIEEDDVTGLTLIAEPVGVVCGITPTTNPTSTAIFKSLISLKTRNPIIFAFHPSAQESSAHAARIVRDAAIAAGAPENCVQWIEQPSIDATNALMNHDGIATILATGGNAMVKAAYSCGKPALGVGAGNVPAYVEKSANIRQAAHDIVMSKSFDNGMVCASEQAVIIDKEIYKEFVEEFKSYHTYFVNKKEKALLEEFCFGAKANSKNCAGAKLNPNIVGKSAVWIAEQAGFTVPEGTNILAAECTEVSEKEPLTREKLSPVIAVLKAESTEDGVEKARQMVEFNGLGHSAAIHTKDADLAREFGTRIRAIRVIWNSPSTFGGIGDVYNAFLPSLTLGCGSYGRNSVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTDLMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHATEAYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 9465 - DNA, 354 bp, Streptococcus agalactiae
gtgatttcgaaaccagataaaaataaaatccgccaaaaacgccaccgtcgtgttcgcggtaaactctctggaactgctgatcgcccacgtttgaacattttccgttctaatacaggcatctacgctcaagtaattgatgacgtagcgggtgtaacgctcgcaagtgcatcaactcttgataaagaagtttctaacggaacaaaaacagaacaagccgttgttgtcggtaaacttgttgctgaacgcgcagtagctaaaggtatttctgaagtggtgtttgaccgcggtggatatctctatcacggacgtgtaaaagctttggctgactcagctcgtgaaaacggattgaaattc

SEQ ID NO: 9466 - protein, 118 aa, Streptococcus agalactiae
MISKPDKNKIRQKRHRRVRGKLSGTADRPRLNIFRSNTGIYAQVIDDVAGVTLASASTLDKEVSNGTKTEQAVVVGKLVAERAVAKGISEVVFDRGGYLYHGRVKALADSARENGLKF

SEQ ID NO: 9467 - DNA, 1161 bp, Streptococcus agalactiae
atgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctatacttttgtacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaa

SEQ ID NO: 9468 - protein, 387 aa, Streptococcus agalactiae
MGELPFLNMLNLVSGNAMRNFSVFSMGVSPYITASIVVQLLQMDILPKFVEWGKQGEVGRRKLNQATRYISLFLAFVQSIGITAGFNTLSSVALVKTPNVQTYLLIGAILTTGSMVVTWLGEQITDKGFGNGVSMIIFAGIISSIPSAITTIYEDFFVNVRSSAITNSYIFVGILIVAVLAIVFFTTFIQQAEYKIPIQYTKLVQGAPTSSYLPLKVNPAGVIPVIFASSITTIPSTIIPFFQNGKEIPWLTKLQELLNYQTPVGMIIYAILIILFSFFYTFVQVNPEKTAENLQKNSSYIPSIRPGRETEEYMSSLLKKLATIGSVFLAFISLLPIIAQQALHLSSSIALGGTSLLILIATGIEGMKQLEGYLLKRRYVGFMNTTE

SEQ ID NO: 9469 - DNA, 459 bp, Streptococcus agalactiae
ttgtttgataaagtaaagccaatcgtaatgaagctgagaagaaattattttgttcaactttgggaatatgatgattggattcaagaaggacgtattgtactttttaggttgcttgaagagcatccgtatttattggataatgaaagcaaactattcatttactttaaaacaaaattttcaaattatttaaacgatgtattaagacaccaagattgtcaaaagcgacaatttaataaaatgccttatgaagaaataagtgaagttagtcactatgttaagagtaaaggactagttttagatgactatattgcttatcgtgatactttaacaaaagtggaagaaactttgtcagatattgataaagaaaaatttgaaaaactgattagtggtgaacgttttgcggggaagaaacaattcatacgagatattcaaccctttttcaatgcttttaaagcggat

SEQ ID NO: 9470 - protein, 153 aa, Streptococcus agalactiae
MFDKVKPIVMKLRRNYFVQLWEYDDWIQEGRIVLFRLLEEHPYLLDNESKLFIYFKTKFSNYLNDVLRHQDCQKRQFNKMPYEEISEVSHYVKSKGLVLDDYIAYRDTLTKVEETLSDIDKEKFEKLISGERFAGKKQFIRDIQPFFNAFKAD

SEQ ID NO: 9471 - DNA, 444 bp, Streptococcus agalactiae
atgtcaaaagtacgtggctttgaattagttagccaatttagcaataaagagttattaccaaaacgagaaacagctcacgcagctggctatgatttaaaagtagctaaaaaaacggttattgaacctggtgaaattacattggtcccgaccggtattaaagcatacatgcaaccaggggaggtcctgtacctttatgatcgttcatcgaatccacgtaaaaaagggattgtcctaataaattcagttggtgttattgatggtgactactataataaccaagtcaatgaaggacatatttttgcacagatgcaaaatattactgatcaggctgttattttagaagaaggggaacggattgttcaggctgtttttgccccattcttattggcagatgacgatcaggctacaggaatgcgtacaggtggttttggtagtactggaaaa

SEQ ID NO: 9472 - protein, 148 aa, Streptococcus agalactiae
MSKVRGFELVSQFSNKELLPKRETAHAAGYDLKVAKKTVIEPGEITLVPTGIKAYMQPGEVLYLYDRSSNPRKKGIVLINSVGVIDGDYYNNQVNEGHIFAQMQNITDQAVILEEGERIVQAVFAPFLLADDDQATGMRTGGFGSTGK

SEQ ID NO: 9473 - DNA, 1206 bp, Streptococcus agalactiae
atgtacgggggaacatgtatcaacattggatgtattccgacaaaaacgcttttagtatcagctagcaaaaatcatgattttcaagaagctatgactactagaaatgaagttacaagtcgtttacgtgctaaaaattttgctatgttggataataaagacactgtggatgtttataatgctaaagcccgctttatatcaaataaagtggtcgaattaacaggaggagctgacaaacaagaacttacagctgatgttattattatcaatactggtgctaagtcagtacaattaccaatcccaggattagctgattctcaacatgtttatgattcaacggcaatccaagaattggctcatcttcctaaacggttaggtatcattggaggcggtaatattgggcttgaatttgcgactttatattccgaattagggagcaaagtgacagttattgatagtcaatcccgtatctttgcgcgtgaggaagaggaattatcagagatggctcaagattatttagaagagatggggatatcttttaaattatcagccgatatcaaatctgtgcaaaatgaagatgaagacgttgttattagctttgaggatgaaaaattaagctttgatgcagtattatatgcaacaggacgtaagccaaatacagaaggtttagcacttgaaaatacagatattaaattgacagaacgtggagctattgctgttgatgaatattgccaaacttctgttgagaatatttttgcagttggtgatgttaatggcggccctcaattcacatatatttctttagatgactcacgtattgtcttaaattatttgaattgtgataaggattattctctaaaaaatcgaggagcagtaccgacttcaacctttacaaatcctcctttagcaacggtaggtctagatgaaaagaccgctaaggaaaaaggatatcaagttaaatctaatagccttcttgtttctgccatgccacgtgcacatgttaataatgaccttagaggtatttttaaagttgtggtagatactgagacaaatcttattttgggagctcgcttatttggtgcagaatcccatgaattaattaatatcatcacaatggcaatggataataaaatcccatatacttatttccaaaaacaaattttcactcacccaacaatggtagagaattttaatgatttgtttaacttt

SEQ ID NO: 9474 - protein, 402 aa, Streptococcus agalactiae
MYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNCDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 9475 - DNA, 1452 bp, Streptococcus agalactiae
ttggctaataagattcgtgtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaatta

SEQ ID NO: 9476 - protein, 484 aa, Streptococcus agalactiae
MANKIRVRYAPSPTGLLHIGNARTALFNYLYARHHGGDFVIRIEDTDRKRHVEDGERSQLENLRWLGMDWDESPETHENYRQSERLELYQRYIDQLLAEGKAYKSYVTEEELAAERERQELAGETPRYINEFIGMSETEKEAYIAEREAAGIIPTVRLAVNESGIYKWTDMVKGDIEFEGSNIGGDWVIQKKDGYPTYNFAVVIDDHDMQISHVIRGDDHIANTPKQLMVYEALGWEAPQFGHMTLIINSETGKKLSKRDTNTLQFIEDYRKKGYMSEAVFNFIALLGWNPGGEEEIFSREQLINLFDENRLSKSPAAFDQKKMDWMSNDYLKNADFESVFALCKPFLEEAGRLTDKAEKLVELYQPQLKSADEIVPLTDLFFADFPELTEAEKEVMAAETVPTVLSAFKEKLVSLSDEEFTRDTIFPQIKAVQKETGIKGKNLFMPIRIAVSGEMHGPELPDTIYLLGKEKSVQHIDNMLAKL

SEQ ID NO: 9477 - DNA, 984 bp, Streptococcus agalactiae
atgagtacgattagacaagtcgccgagaaagctggcgtatcaacatctactgtctcaaggtatatatcccaaaatggttacgttagtcaaaaagcaagtcaaaaaatcgagcaagctatccgcgaactccattatgttccaaatttccttgcacaatctctgaaaaccaaaaaaaatcaacttgttggattactacttcccgatatttcaaaccctttctttccaagacttgctagaggagttgaagaatttctaaaagaacagggttatcgtgtcatgcttggcaacacaaataacaagagccatttagaagaagagtacttaaatgtgctattacaaagtaatgctgcagggattattacaacacacgatttcaccaaaaatcatcctgaaatagatattccagttgtagttgttgaccgcgttaatcaagaaacacagtacggcgttttctctgataataaagagggaggaaaattagcagctcaagctatttggacagcaggtgctaccaatatattactcattcgtggtccgctagataaagctgataaccttaatcaaaggtttcaaggaagccaaaattacctattaaacaaaggggcttgttttgctatcgaagatagtgccagttttgattttgcagagattcaaattgaagcgaaaactttacttgaccaccatccagacattgatagcattatcgctccatctgatatacatgctattgcctacctacacgagattcttaatcgagggaagcgaatccctgaagatgtacaaattattggttatgatgatattttaatgagccaatttatctacccttcgttgtcaactattcaccaatcatcatatattatgggacaaaaagcagctgaattaattttcaaaattactaatcaattacctattaccaataagcgtattaaattacccgttcattatgtcgaacgtgaaaccctaaggaggaaaatagatgag

SEQ ID NO: 9478 - protein, 328 aa, Streptococcus agalactiae
MSTIRQVAEKAGVSTSTVSRYISQNGYVSQKASQKIEQAIRELHYVPNFLAQSLKTKKNQLVGLLLPDISNPFFPRLARGVEEFLKEQGYRVMLGNTNNKSHLEEEYLNVLLQSNAAGIITTHDFTKNHPEIDIPVVVVDRVNQETQYGVFSDNKEGGKLAAQAIWTAGATNILLIRGPLDKADNLNQRFQGSQNYLLNKGACFAIEDSASFDFAEIQIEAKTLLDHHPDIDSIIAPSDIHAIAYLHEILNRGKRIPEDVQIIGYDDILMSQFIYPSLSTIHQSSYIMGQKAAELIFKITNQLPITNKRIKLPVHYVERETLRRKIDE

SEQ ID NO: 9479 - DNA, 882 bp, Streptococcus agalactiae
atgtcattaattattcttacggttattttggttttagtgattgttctgttgataacttctttatacgttgttaaacaacagacagtagccatcattgaacgctttggtaaatatcaaaagactgctactagcggtattcatattcgtgtaccattgggtatcgataagattgcagcacgagtgcagttacgtcttttacagagtgaaattatcgttgagacaaaaacaaaagataatgtttttgtcactttaaatattgctacacaatatcgtgtcaatgaaaataacgttacagacgcttattacaaattaataaagccagaagctcagattaaatcttatatcgaagatgctttgcgttcatcagtacctaaacttacattagacgagctatttgaaaagaaagatgaaatagccttggaagttcaacatcaagtggcagaagaaatgtcaacatacggctacatcattgttaagactttaattactaaggttgagccagatgcagaagtaaaacaatccatgaacgaaatcaatgctgcacaacgtaaacgtgtagcagctcaagaattagcgaatgctgataagatcaaaattgtaactgctgcagaagcagaagcagaaaaagatcgtctacatggtgtgggtattgcgcaacaacgtaaagcaattgtagatgggttagctgattcgattcaagaattgaaagatgctaacgtgacattgacagaagaacaaatcatgtctatcttgttaacaaatcaatatttagatactttaaatacatttgctattaatggtaatcaaacgattttcttaccaaataacccagaaggtgttgaagatattcgtacacaagttttatctgctcttaaaacaaga

SEQ ID NO: 9480 - protein, 294 aa, Streptococcus agalactiae
MSLIILTVILVLVIVLLITSLYVVKQQTVAIIERFGKYQKTATSGIHIRVPLGIDKIAARVQLRLLQSEIIVETKTKDNVFVTLNIATQYRVNENNVTDAYYKLIKPEAQIKSYIEDALRSSVPKLTLDELFEKKDEIALEVQHQVAEEMSTYGYIIVKTLITKVEPDAEVKQSMNEINAAQRKRVAAQELANADKIKIVTAAEAEAEKDRLHGVGIAQQRKAIVDGLADSIQELKDANVTLTEEQIMSILLTNQYLDTLNTFAINGNQTIFLPNNPEGVEDIRTQVLSALKTR

SEQ ID NO: 9481 - DNA, 1881 bp, Streptococcus agalactiae
atgaagaaatgttttttggctatttgtttagctcttagtttttttatggtttcagttcaagcagatgaggtggactataacattcctcattatgagggtaatctaactattcacaatgataatagtgctgattttacagagaaggttacttaccaatttgattcgtcctataatggacagtatgtcacattaggtacggcgggtaagttacctgacaattttgatattaataataagccacaggttgaagtttcaattaatggtaaagtaaggaaagttagttaccagatagaagatttggaggatggctaccgtttgaaagtgtttaatggtggtgaagcaggtgatactgttaaagtcaatgttcagtggaaactaaaaaatgttctatttatgcataaggatgttggtgaacttaactggattcctattagcgactgggataaaacgttagagaaagtagatttttggatatcaactgacaaaaaggttgctctttctcgtctttgggggcacttgggttatcttaaaactcctcctaaaataagacaaaataataatcgttaccatttgacagcttttaatgtaaacaaacgattagaatttcatggttattgggatagatcttattttaatctacctacaaacagtaaaaataattacaagaaaaaaattgaatatcaagagaagatgatagagcgtcatggttttatcctaagtttcttgttaaggatattattaccttcattctttattattgtgacactattcatctcaattagggtgttcctgtttagaaaaaaagttaataaatacgggcaattccctaaggaacatcatttatatgaagcacctgaggacctttcaccactagagttaactcaaagcatttatagtatgagttttaaaaattttcaagatgaggagaagaaaactcaccttatcagtcaagaacaactcattcagtcaattctattagacttgattgatagaaaagtattgaattatgatgataacttgttatctctagctaacttagatagagcttctgatgcagaaatagattttatagagtttgcttttgcggattctacgagtttgaagccagatcaactcttttctaattaccaatttagttataaagaaacactacgtgaactgaaaaagcagcacaaggcttcagatctgcaaactcaaatgagacgccgaggaagtaatgccttatcaagaattacgcgtctcacaaggttgatttctaaagacaatataaactctcttagaagaaagggaatttcatccccttatcgtaaaatgtcttcagaagagtctaaagaattatctaggttgaaaagattcagttacctatcacctcttatttcttttgttgttataatttatacgctttttttaaattattttacctatttctgtatctatctcttattgtttggtgttatcctgttgttgaataaaatcatttttatgatgacaagaaaaataagtaacggttatattgtaactgaagatggagcaagtcgtgtctaccaatggactagttttaggaacatgctaagggatatcaaatcgtttgatcgttcagagttagaaagtatcgtattatggaatcgaatattggtttacgctactttattcggctacgctgaccgtgttgagaaagcactcagagtgaaccaaatagatattccagaaagatttgcaaacattgatagtcatcaatttgcgatttcagtcaatcaatctagtaatcatttttcaacgataactgaagatgttagtcacgcttctaattttagtgttaattcaggcggttcttcaggtggtttctcaggcggcggaggcggcggaggtggtggtgccttc

SEQ ID NO: 9482 - protein, 627 aa, Streptococcus agalactiae
MKKCFLAICLALSFFMVSVQADEVDYNIPHYEGNLTIHNDNSADFTEKVTYQFDSSYNGQYVTLGTAGKLPDNFDINNKPQVEVSINGKVRKVSYQIEDLEDGYRLKVFNGGEAGDTVKVNVQWKLKNVLFMHKDVGELNWIPISDWDKTLEKVDFWISTDKKVALSRLWGHLGYLKTPPKIRQNNNRYHLTAFNVNKRLEFHGYWDRSYFNLPTNSKNNYKKKIEYQEKMIERHGFILSFLLRILLPSFFIIVTLFISIRVFLFRKKVNKYGQFPKEHHLYEAPEDLSPLELTQSIYSMSFKNFQDEEKKTHLISQEQLIQSILLDLIDRKVLNYDDNLLSLANLDRASDAEIDFIEFAFADSTSLKPDQLFSNYQFSYKETLRELKKQHKASDLQTQMRRRGSNALSRITRLTRLISKDNINSLRRKGISSPYRKMSSEESKELSRLKRFSYLSPLISFVVIIYTLFLNYFTYFCIYLLLFGVILLLNKIIFMMTRKISNGYIVTEDGASRVYQWTSFRNMLRDIKSFDRSELESIVLWNRILVYATLFGYADRVEKALRVNQIDIPERFANIDSHQFAISVNQSSNHFSTITEDVSHASNFSVNSGGSSGGFSGGGGGGGGGAF

SEQ ID NO: 9483 - DNA, 621 bp, Streptococcus agalactiae
atggatgaattagacttgccagaaaactttaaaaatagtggtatgttaagttttcgagtaacacctaaaaaagatcgcattgatgtttttgttacaaagtctgaattaagtaaagatttaaatttagaagaattagcagatttgggtgacatttcaaaaatgtctccagaagacttttttaaaacattggaacaatcgatgttggaaaaaggggatacggatgcccatgccaaattagcagaaattgaaaatatgatggataaagcaactcaagaagtagttgaggaaaatgtttctgaagaacaacctgaaaaggaagtagaaacgattggatatgttcactatgtctttgattttgataatattgaagctgtagttcgattttcacaaacgattgattttccaatagaagcttctgaactctataaaaatggtaaaggctatcatatgacaattttgctagacttggaaaaccaaccaagctactttgctaatttgatgtatgctcgaatgcttgaacatgctaatgtgggcacaaaaacacgagcttacttgaaagagcatagtattcaattgattcatgatgatgctatttcaaaattacaaatgattgagatggga

SEQ ID NO: 9484 - protein, 207 aa, Streptococcus agalactiae
MDELDLPENFKNSGMLSFRVTPKKDRIDVFVTKSELSKDLNLEELADLGDISKMSPEDFFKTLEQSMLEKGDTDAHAKLAEIENMMDKATQEVVEENVSEEQPEKEVETIGYVHYVFDFDNIEAVVRFSQTIDFPIEASELYKNGKGYHMTILLDLENQPSYFANLMYARMLEHANVGTKTRAYLKEHSIQLIHDDAISKLQMIEMG

SEQ ID NO: 9485 - DNA, 1107 bp, Streptococcus agalactiae
ttgtatgaaaaagatgctaacaaacccgctgctattgcttccttgactaaaataatgaccgtttatatggtctataaagaaattgataacggtaacctcaagtggaataccaaagtaaatatatctgactacccttatcaactaacacgcgaatctgatgctagtaatgttcctttagaaaaaaggcgctatactgttaaacagctcgtggacgctgccatgatttctagtgctaacagtgcagccattgctttggctgaacatatttcaggaaccgaaagtaaatttgttgataaaatgactgctcaattggaaaagtggggaattcatgatagccacctagtcaatgcttctggcttaaataatagtatgttaggcaatcacatttatccaaaatcgtcacaaaacgacgaaaataaaatgagtgcacgtgatattgctattgttgcctaccatttggtcaacgaatatccttccattcttaagattactagtaagtccgttgctaaatttgataaagatattatgcattcttataactacatgctaccagatatgcctgtctttagaccaggtattacaggtttgaaaactgggacaacggaattagctggccaatcttttattgctacatctactgaaagtggaatgagactactcactgttattatgcatgctgataaggccgataaagacaaatatgctcgctttacagcaactaactctctcttgaactatatcacaaacacctacgaacctaaccttgtattagctaaaggagctgcatataaaggtaaagaagcaagtgtgagagacggaaaagaacaatcggtcatcgctgttgctaaaaacgatttgaaagtagtacagaagaaaaatatcactaaacaaaatcagttaaaaattaactttaaaaaagagcttactgctcctattacaaaaaaagagaacctagggaaagcttattacgttgaccttaataaggttggaaaaggctatctcataaaggaacctagcgttcatttagtggcaaaagatagtattgagcgcagtttcttcctcaaagtgtggtggaatcattttgtgcgctacgttaacgaaaaactt

SEQ ID NO: 9486 - protein, 369 aa, Streptococcus agalactiae
MYEKDANKPAAIASLTKIMTVYMVYKEIDNGNLKWNTKVNISDYPYQLTRESDASNVPLEKRRYTVKQLVDAAMISSANSAAIALAEHISGTESKFVDKMTAQLEKWGIHDSHLVNASGLNNSMLGNHIYPKSSQNDENKMSARDIAIVAYHLVNEYPSILKITSKSVAKFDKDIMHSYNYMLPDMPVFRPGITGLKTGTTELAGQSFIATSTESGMRLLTVIMHADKADKDKYARFTATNSLLNYITNTYEPNLVLAKGAAYKGKEASVRDGKEQSVIAVAKNDLKVVQKKNITKQNQLKINFKKELTAPITKKENLGKAYYVDLNKVGKGYLIKEPSVHLVAKDSIERSFFLKVWWNHFVRYVNEKL

SEQ ID NO: 9487 - DNA, 810 bp, Streptococcus agalactiae
atgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgt

SEQ ID NO: 9488 - protein, 270 aa, Streptococcus agalactiae
MLLDMLSYDFMQRALLAVVAISIFAPILGIFLILRRQSLMSDTLSHVSLAGVALGVVLGISPTWSTIFVVTLAAVVLEYLRTVYKHYMEISTAILMSMGLAISLIVMSKAHNVGNVSLEQYLFGSIITIGKEQVIALFVIALITFILTILFIRPMYILTFDEDTAFVDGLPVRTMSILFNVVTGIAIALTIPAAGALLVSTIMVLPASIAMRLGRNFKTVIFLGMLIGFVGMVAGIFLSYYWETPASATITMIFIGIFLLVSLVGLLRKR

SEQ ID NO: 9489 - DNA, 846 bp, Streptococcus agalactiae
atgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatca

SEQ ID NO: 9490 - protein, 282 aa, Streptococcus agalactiae; identical to SEQ ID NO: 8494

SEQ ID NO: 9491 - DNA, 663 bp, Streptococcus agalactiae
gtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataac

SEQ ID NO: 9492 - protein, 221 aa, Streptococcus agalactiae
MSFIIRKGKILALLIAFLVINQLVPILAVWLLKNHYQTPFTSILLIGLELLIIALFLYYAKVKQIIRWKALLTRKALVTILLGWLSLRVPQIIGYLIMTMQGVKDTANQTVIMELTKQLPLALMLIFAIIGAPIMEEIIFRYIIPKELFAKHQKWGFVIGTLAFALIHSPSDIGSFIIYAGMGAILSFVYYKTEHLEYSIMIHFINNALAYSVLISTMMNN

SEQ ID NO: 9493 - DNA, 642 bp, Streptococcus agalactiae
atggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggag

SEQ ID NO: 9494 - protein, 214 aa, Streptococcus agalactiae
MEKVIIFDMDGVIVDSEYTFLDNKTEMLREEGIDTDVSYQYQYMGTTFEFMWQAMKEEFGLPKTVKEYIAEMNRRRQAIVARDGVRPIKGAQRLIHWLHQHGYRLAVASSSPMVDIKRNLKELGVTECFEYMVTGEDVSSSKPAPDVFLRAAELLDVDPKVCIVIEDTRNGSLAAKAAGMYCFGFANPDYPPQDLSMADKVISDYQDIYIYLPE

SEQ ID NO: 9495 - DNA, 738 bp, Streptococcus agalactiae
atgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatg

SEQ ID NO: 9496 - protein, 246 aa, Streptococcus agalactiae
MKILILDDEMFARQELSFLVEHSQEVDNPEIFQAEDISEAEKILFRQQIDLIFLDISLSEENGFTLANQLSQLAHPPLVVFATAYDNYAVKAFESNAVDYIMKPFEQQRVDMALSKVKKLSQLTTASDVEQAIPKKASVELLTLTLSDRSVVVKMQDIVAASVEDGELTVSTVQKTYTIRKTLNWFKSRAVAPYFLQIHRNTVINLEMIEEIQPWFNHTLLLIMSNGEKFPVGRSYLKDLNEHLTM

SEQ ID NO: 9497 - DNA, 990 bp, Streptococcus agalactiae
atggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 9498 - protein, 330 aa, Streptococcus agalactiae
MEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 9499 - DNA, 750 bp, Streptococcus agalactiae
atggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatca

SEQ ID NO: 9500 - protein, 250 aa, Streptococcus agalactiae
MVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 9501 - DNA, 2127 bp, Streptococcus agalactiae
atgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatct

SEQ ID NO: 9502 - protein, 709 aa, Streptococcus agalactiae
MSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKIRPDGRRVDEIRPLDAEIDFLPQVHGSGLFTRGQTQALSVLTLAPMGEAQIIDGLTPEYKKRFMHHYNFPQYSVGETGRYGAAGRREIGHGALGERALEQVLPRLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 9503 - DNA, 582 bp, Streptococcus agalactiae
atggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactt

SEQ ID NO: 9504 - protein, 194 aa, Streptococcus agalactiae
MGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 9505 - DNA, 297 bp, Streptococcus agalactiae
atgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaa

SEQ ID NO: 9506 - protein, 99 aa, Streptococcus agalactiae
MQGFTKPNQLHRKATQYVSANAQALLINAMLEENILTDEEQLIYKRGRNANSHTKAKNADIITYRMSTGFEALMGYLDMTGQIKRLETLIQWCIETIEK

SEQ ID NO: 9507 - DNA, 444 bp, Streptococcus agalactiae
atgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatc

SEQ ID NO: 9508 - protein, 148 aa, Streptococcus agalactiae
MNKTTFMAKPGQVERKWYVVDAADVPLGRLSAVVASVLRGKNKPTFTPHTDTGDFVIVINAEKVKLTGKKASDKIYYTHSMYPGGLKQISAGELRSKNAVRLIEKSVKGMLPHNTLGRAQGMKLKVFVGGEHTHAAQQPEVLDISGLI

SEQ ID NO: 9509 - DNA, 996 bp, Streptococcus agalactiae
atggtccgactccgaaggggtcggcttggggctactcccccaagaatgtcattttacgtaggcctttgcgcagacaaaaaaatcggcgccgttaggcgaccgccaaaaagaaaggaggtttgtttgaaattaaaagtcagcttagacaatatcactatgacagcctatatcaaatctaaaaagtatttagctatgaaacaactcatagaaacccatttagctattactgttcaaactgcgatgactgacatgtttcgagccaccactggggatggaatccacgttgtgctccatatgaattatgacaaacaaaaaggacaagaccgcaaggctcgtccatttcgcttggagtttaatcccaataaactccgtttagttgacagtgaaattatagatactattataccatttcttgaagatatttcaatatcacgtgctgatttagcttttgatctatttgaggttgattgtagtgagtttgtgctcgaaaaaaagggcagaccaaccgcaaccaaggaatttcgttctagtactggaacgttagaaacaaaatatctaggtgctccacgttctgaaaaacaagttaggctatataacaagaaaaaggaacaactccaaaatggtactgataaagataaagactttgcaagtcaatttaagcactggtggcgcttggaatttcaattaagaagccgttcaattgatgagatattcgaggttattgatactattatttttaaaccattcaatcttaaaggcttatctattgagacccaaatctatctaactgctcttattcacgataaaaatatctggaaaaaactccatagaaatacaagagcaagatacaaaaaaattttagaaactcatcaaacatcagatactgattatttaggtttgctgaaagacttgttgaagcatgaaagaccaagactagaaaatcagctcgcttattatgggggtaggatagacaaaaatagctttcaacccttttgt

SEQ ID NO: 9510 - protein, 332 aa, Streptococcus agalactiae
MVRLRRGRLGATPPRMSFYVGLCADKKIGAVRRPPKRKEVCLKLKVSLDNITMTAYIKSKKYLAMKQLIETHLAITVQTAMTDMFRATTGDGIHVVLHMNYDKQKGQDRKARPFRLEFNPNKLRLVDSEIIDTIIPFLEDISISRADLAFDLFEVDCSEFVLEKKGRPTATKEFRSSTGTLETKYLGAPRSEKQVRLYNKKKEQLQNGTDKDKDFASQFKHWWRLEFQLRSRSIDEIFEVIDTIIFKPFNLKGLSIETQIYLTALIHDKNIWKKLHRNTRARYKKILETHQTSDTDYLGLLKDLLKHERPRLENQLAYYGGRIDKNSFQPFC

SEQ ID NO: 9511 - DNA, 432 bp, Streptococcus agalactiae
atgagaataaaagattatgctgatagtctaggagttagtagccaatctatctataaacgcatacgctctccaaaatataaagaaaggttgaaaggtcatttataccgagacaaccaaaaggttgaaaatcttgatttgataggcattaaaatacttgaagattatcattttgagaatgatgtcattgaactggaaaaaacgctgggtgatattcaagaagaattcgagcaagaaaagaagggaatgcaatatcggatagatagactagctgataagttaactcctttacttgaggataaccaaaacttggtacaaaaaaattatgagttactcaactatgttcggagcttggaacgacagaagctattgctgattattgctttagctgtcatggtaatcactttattagtggcaatatggcttgccatcttt

SEQ ID NO: 9512 - protein, 144 aa, Streptococcus agalactiae
MRIKDYADSLGVSSQSIYKRIRSPKYKERLKGHLYRDNQKVENLDLIGIKILEDYHFENDVIELEKTLGDIQEEFEQEKKGMQYRIDRLADKLTPLLEDNQNLVQKNYELLNYVRSLERQKLLLIIALAVMVITLLVAIWLAIF

SEQ ID NO: 9513 - DNA, 288 bp, Streptococcus agalactiae
atgtcacaaattaaactaacacctgaagaactccgtatttcagcacaaaaatatacaacaggatcacaatcaattacagatgtgttaacagttttgactcaagaacaagctgttattgatgaaaattgggatggtacagcatttgatagctttgaagcccaattcaatgaattatctccaaaaatcacacaatttgcacaattattagaagatataaatcaacaattattgaaagttgcggatgttgtcgaacaaacagactcagatattgcctcacaaattaataaa

SEQ ID NO: 9514 - protein, 96 aa, Streptococcus agalactiae
MSQIKLTPEELRISAQKYTTGSQSITDVLTVLTQEQAVIDENWDGTAFDSFEAQFNELSPKITQFAQLLEDINQQLLKVADVVEQTDSDIASQINK

SEQ ID NO: 9515 - DNA, 102 bp, Streptococcus agalactiae
atggaggaattttgtatggtaagtactcaatatatgaaagtaaccttacgagaaaaattcccagataaattaacatatgttgatttagaagaacttgtgata

SEQ ID NO: 9516 - protein, 34 aa, Streptococcus agalactiae
MEEFCMVSTQYMKVTLREKFPDKLTYVDLEELVI

SEQ ID NO: 9517 - DNA, 924 bp, Streptococcus agalactiae
atgcttaaaaaatcgcactttttacagatatttacactttgcttagccctcttaacgatttctggttgtcaattaaccgatactaaaaagtctggtcataccacaattaaggttgctgcccaaagttctacagagtctagtattatggcaaatattatcaccgaattaattcatcacgaattaggatacaacacaactttaataagcaatcttggttcctctacggttactcaccaagctttgctccgtggtgatgctgacattgctgccacacgttatacaggaacagacatcacagggactcttggtttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcactaagatctctgatcttaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaa

SEQ ID NO: 9518 - protein, 308 aa, Streptococcus agalactiae
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 9519 - DNA, 159 bp, Streptococcus agalactiae
atgaaaaaatatataaaatggttaattcccatatctattattgggatgttactagtaggctgtcaaatgaataggggacctaaaagtcagtcaaacgaagtaaaaaatagcaagcaatcagaagtgaagaaaggtaaaaatatgataaaaaagaacagt

SEQ ID NO: 9520 - protein, 53 aa, Streptococcus agalactiae
MKKYIKWLIPISIIGMLLVGCQMNRGPKSQSNEVKNSKQSEVKKGKNMIKKNS

SEQ ID NO: 9521 - DNA, 801 bp, Streptococcus agalactiae
atgagcccttatactttcttacgtgctataggccctgagccttggaatgctgcatacgttgaaccatcacgtcgtccagctgacggccgctatggcgaaaatccaaaccgtctttaccaacatcatcaatttcaagtggtaatgaagccttcgccgtcaaatattcaagaactttatttgaagtctttggaattactaggtatcaatccacttgagcatgatatccgttttgttgaagataactgggaaaatccatctacaggttcagctggattaggttgggaagtttggcttgatggaatggaaataacacaatttacttatttccaacaagtaggtggacttcaaacaggtcctgtaacttctgaagttacttatggactagagcgtttagcctcttatattcaagaggtagattctgtttatgatattgagtgggcaccaggtgttaaatatggtgaaatctttactcagccagagtatgagcattcaaaatattcatttgagatatcagaccaagtaatgttacttgaaaactttgagaaatttgaaagagaagcaaaacgtgctttagaagaaggacttgttcatccagcttatgactacgtccttaaatgttcacacacctttaatttattagatgcacgtggagcagtatctgttactgagcgtgcaggctatattgcacgtatccggaatttagcacgtgttgttgctaaaacctttgttgccgaacgtaaaaaacttggtttcccacttttggatgaggaaactcgtatcaaattacttgctgaggaagac

SEQ ID NO: 9522 - protein, 267 aa, Streptococcus agalactiae
MSPYTFLRAIGPEPWNAAYVEPSRRPADGRYGENPNRLYQHHQFQVVMKPSPSNIQELYLKSLELLGINPLEHDIRFVEDNWENPSTGSAGLGWEVWLDGMEITQFTYFQQVGGLQTGPVTSEVTYGLERLASYIQEVDSVYDIEWAPGVKYGEIFTQPEYEHSKYSFEISDQVMLLENFEKFEREAKRALEEGLVHPAYDYVLKCSHTFNLLDARGAVSVTERAGYIARIRNLARVVAKTFVAERKKLGFPLLDEETRIKLLAEED

SEQ ID NO: 9523 - DNA, 1278 bp, Streptococcus agalactiae
atgacttgtgcgcagaaattacgccaattaaatcctaattgggatatcgttttgattgataaagaaattcatccagattatgttccaaatggcttaaattggtattatcgtcacgaaattagtggtttaaatcaggccatgtggcagacagaagaagagcaacggttgcagaatatacgctgtctatttggtctaaaagttgagaaaattaataaagaagatagggaattaatgttatcagatggttcttctgtctattatgatcaattgatttgtgccatgggctcccaagcagaatcaacttatattgatggggctgatgcgcaaggtgttttaacaacaaaaacttatgcaactagtcaaaatgctaagcaggtattagataaaagtcataaggtagcagttgttggggcaggtatcatcggtttagatattgcttatagtttacatgaatcagggaaggcggtcactttgttagaagctcaagaaagaccagacttcaggcatacagatcctgatatgtcccttcctttacttgatgcgatggctgaatcaaaactacattttttccaaaatcaaaaggttgagaaaattactgtaacccgagaagaaaaactttgtttgcgaacgctaacaggagacacctttacagttgatgctgtcatattagctgttaattttcgtccggatagtcgtcttttaactgggttggttgatttaagtgttgataatagtgttgttgtaaatgattatttccaaacgagtgaccctaatatctatgctattggcgatttgatttggtcgtattttaaaggtcttaatagtgcttattatatgcccttaattaaccaagcaatccgttcggcacaaatgttggcataccatttatcgggacatgctgttccaaaattaaaaataacacgcgctacaggatctaaacactttggctattatagagctaacattggattaactgaattggaagctggtttttacgaggataccgttagtgttacttatttccctaaagaacagtatgatttaaggataaaattgattgctaaccaaaaaacgggccatttattgggggctcaattaatctcaaaggaaaattgtttggctactgccaatcagcttgttcaagctatatcgtgtgatatgacagattttgatctggcttttcaagatttcatttatacagctagagaatctgagatggcttatatgttgcatcaagcagctatcaacctttatgaaaagaggattgggctatgcgaa

SEQ ID NO: 9524 - protein, 426 aa, Streptococcus agalactiae
MTCAQKLRQLNPNWDIVLIDKEIHPDYVPNGLNWYYRHEISGLNQAMWQTEEEQRLQNIRCLFGLKVEKINKEDRELMLSDGSSVYYDQLICAMGSQAESTYIDGADAQGVLTTKTYATSQNAKQVLDKSHKVAVVGAGIIGLDIAYSLHESGKAVTLLEAQERPDFRHTDPDMSLPLLDAMAESKLHFFQNQKVEKITVTREEKLCLRTLTGDTFTVDAVILAVNFRPDSRLLTGLVDLSVDNSVVVNDYFQTSDPNIYAIGDLIWSYFKGLNSAYYMPLINQAIRSAQMLAYHLSGHAVPKLKITRATGSKHFGYYRANIGLTELEAGFYEDTVSVTYFPKEQYDLRIKLIANQKTGHLLGAQLISKENCLATANQLVQAISCDMTDFDLAFQDFIYTARESEMAYMLHQAAINLYEKRIGLCE

SEQ ID NO: 9525 - DNA, 1410 bp, Streptococcus agalactiae
atggaaaaagaaaggcgtgttcaatatcggctactttcttttttaagaggctctcctcaggcaatagcactgaagttagctttattagaaactggtttaagtcgagcaacttttcttaaatatatcaataatcttaatagctactttgaacaagaaaaagttaattgtcgaatcgtttattataaggataagttatttttagaagaggattataacttatccaatcaagaagtgttgaaagctctgatgaaagatagtattaaatacactatcttaatatctttatttaatcagcgtcagttcacaatcgttggtctttctcaagaattgatggttagtgaggctactttaaatcgtcatcttgctcatctcaatgaattgttagcggaatttgatattgctatttcacaaggaaaacagattggtgatgaattgcaatggcgttatttttattatgaattattcaagcaactatggtcttatgacaagtgccaaaatatgataaagaaattagacttagactcattaattctattaatagagcgcttggctcaacatactttaactcgagaagctcatcaaaatctgggactttggtttagtatttgtcatcatcgtctccttgctatggaaaaaatatctgataatctcaagcctattgtgaaacattatcaatgtaatgctttttataaacggttagacgcagccttagttttgtatatgagtcgttttgctcttgagtatagggaaggagaagttctggcaacttttgcttttctacattcacaaaatattttaccaatcaatacaatggaatacatcatgggatttggaggcccgattattgattgtgtaaccgaaacaatcatctactttaaaaaggagagtattttagctgacgagacatcagatcaggttatttaccaacttggtcagttatatagccattattatttctttaaaggtcatattttagttgaacaacctgatttagaacaaacgtatcgacttattgatcataatatgagggataagttgcatcatatttcaaagaagattattgcaaatgttaatcgaattagacctttaacagaagatggttgttctttgctgactttacatttgttggaattgcttattttctcgaaaaatagtcaaaaaatgccctttaggattggtctagatatgacaggtaatgctgtggaacagtcattgttggaatatcgcattcgacaacatttctctggtaataattctattcaagtcgaaccttatgacgaaggaaagggatttgatatggttatttatcagagtcactcaagaccttataaagccaaactaacctattgccttaataaaggtgcttcagagcgagaactacaggaaatagattcacttatttatgacaat

SEQ ID NO: 9526 - protein, 470 aa, Streptococcus agalactiae
MEKERRVQYRLLSFLRGSPQAIALKLALLETGLSRATFLKYINNLNSYFEQEKVNCRIVYYKDKLFLEEDYNLSNQEVLKALMKDSIKYTILISLFNQRQFTIVGLSQELMVSEATLNRHLAHLNELLAEFDIAISQGKQIGDELQWRYFYYELFKQLWSYDKCQNMIKKLDLDSLILLIERLAQHTLTREAHQNLGLWFSICHHRLLAMEKISDNLKPIVKHYQCNAFYKRLDAALVLYMSRFALEYREGEVLATFAFLHSQNILPINTMEYIMGFGGPIIDCVTETIIYFKKESILADETSDQVIYQLGQLYSHYYFFKGHILVEQPDLEQTYRLIDHNMRDKLHHISKKIIANVNRIRPLTEDGCSLLTLHLLELLIFSKNSQKMPFRIGLDMTGNAVEQSLLEYRIRQHFSGNNSIQVEPYDEGKGFDMVIYQSHSRPYKAKLTYCLNKGASERELQEIDSLIYDN

SEQ ID NO: 9527 - DNA, 1869 bp, Streptococcus agalactiae
atggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactt

SEQ ID NO: 9528 - protein, 623 aa, Streptococcus agalactiae
MAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYVWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 9529 - DNA, 303 bp, Streptococcus agalactiae
atgaagaaggagtgtcgtgatttttatcggcagatacagcatacttacaatgatatatctgtccgtgaagatgcagtgctatcatcaatactattatcagcatcgaatggtttgataaaaactagcgatgtacctcgtgttgcttatgagttaactcagcaattggaaaataatgagatagaaaaatctttcgagtcattagctacagttaaggaattgaaaaaatctgctaaaaaattgtctgagagatatgagcaaaataaggtaacaacgggattgctttctaaagtatttggaaatcat

SEQ ID NO: 9530 - protein, 101 aa, Streptococcus agalactiae
MKKECRDFYRQIQHTYNDISVREDAVLSSILLSASNGLIKTSDVPRVAYELTQQLENNEIEKSFESLATVKELKKSAKKLSERYEQNKVTTGLLSKVFGNH

SEQ ID NO: 9531 - DNA, 894 bp, Streptococcus agalactiae
atgcttgatattaagccggatggtatctatgtagatgctactttaggtggggcaggacacagcgaatatcttctttcacaattaggcccagatgggcacctttacgcatttgaccaagaccagaaggctattgacaatgctcatatacgtttaaagaaatatgtggataccggtcaagtaacctttatcaaagataatttcagaaatctatcttctaacttaaaagcattaggagtgtcggaaattaatggtatttgttatgatttaggtgtatcaagcccacagctggacgagcgtgaacgcggtttctcatataaacaagacgccccccttgatatgcgaatgaatagagagcagagtcttacagcttatgacgttgtgaacacttatagttatcatgatttagtaaggattttctttaagtatggcgaagataaattttcaaaacaaattgctcgaaaaattgagcaagtacgagctgaaaaaacaatatctacaacaacagaattggctgagattatcaaatcgtctaaatctgccaaagaactgaagaaaaaaggtcatccagctaaacaaatttttcaagctattcgtattgaagtcaatgacgaactaggagctgcagatgaatctatacaacaagcaatggacttattagctgttgatggtcgtatatctgtcatcacttttcattctttagaagatcgtcttactaagcaactttttaaagaagcatcaacagtagaagtacctaaaggtcttccttttataccagatgatttacaacctaagatggagctcgttaatcgtaaacccatcttaccaagtcaagaagaactagaagcgaacaatcgtgcccattcagcgaaattgagagtagcgcgtcgtattcga

SEQ ID NO: 9532 - protein, 298 aa, Streptococcus agalactiae
MLDIKPDGIYVDATLGGAGHSEYLLSQLGPDGHLYAFDQDQKAIDNAHIRLKKYVDTGQVTFIKDNFRNLSSNLKALGVSEINGICYDLGVSSPQLDERERGFSYKQDAPLDMRMNREQSLTAYDVVNTYSYHDLVRIFFKYGEDKFSKQIARKIEQVRAEKTISTTTELAEIIKSSKSAKELKKKGHPAKQIFQAIRIEVNDELGAADESIQQAMDLLAVDGRISVITFHSLEDRLTKQLFKEASTVEVPKGLPFIPDDLQPKMELVNRKPILPSQEELEANNRAHSAKLRVARRIR

SEQ ID NO: 9533 - DNA, 2190 bp, Streptococcus agalactiae
atgggatttattatcttagctattgtaataggtgggctcctatttgcatactacgttagtcgttctccgaaattaaccgatcaagctttaaaatccgttaactctagtttggtttatgatggtaataataaacttattgccgatttaggctcagaaaagcgtgaaagtgttagtgcggatagcattccactaaatttggttaacgctatcacttctatcgaagataaacgtttctttaaacatagaggtgtcgatatttatcgtattttaggtgcagcttggcataatcttgttagtagtaatacgcaaggtggttcaacccttgatcaacagttgattaaactggcttacttttctaccaataaatctgaccaaacgttaaaacgtaaatcacaggaagtttggcttgcgcttcaaatggagcgtaaatacaccaaagaagaaattcttactttctatattaataaagtttatatgggaaatgggaattatggtatgagaacaacagctaaatcatactttggtaaagacctaaaggaattatctattgcacaacttgctttgctcgctggtattcctcaagcacctacacaatatgacccttataaaaacccagaatctgctcaaacaagacgtaataccgttcttcagcagatgtatcaagataaaaacatttctaaaaaggaatacgaccaagctgttgcaactccagtaactgatggcttaaaagaattaaagcaaaaatctacttatccaaaatatatggataactacttaaaacaagttattagtgaagttaaacaaaaaactggtaaagatatctttactgctgggctaaaagtgtatactaatatcaacactgatgcacaaaaacaactatatgacatctacaacagtgacacttacatcgcttatccaaacaatgaattacaaatagcatctaccatcatggatgcgactaatggtaaagtcattgcacaattaggcgggcgtcatcagaatgaaaatatttcatttgggacaaatcaatctgtcttaacagaccgcgattggggttctacaatgaaacctatctcagcttatgcacctgctattgatagtggtgtctataattcaacaggtcaatcattaaacgactcagtttactactggcctggtacttctactcaactatatgactgggatcgtcaatatatgggttggatgagtatgcagaccgctattcaacaatcacgtaacgtccctgctgtcagagcacttgaagccgctggattagacgaagcaaaatctttccttgaaaaattaggcatatactatccagaaatgaactattcaaatgctatttcaagtaacaacagtagcagtgatgcaaaatatggtgcaagtagtgagaaaatggcagcggcttactcggcttttgcaaacggcggaacttactataaaccgcaatatgttaataaaattgaatttagcgatggaaccaatgatacttatgcagcgtctggtagccgtgcgatgaaagagactactgcctacatgatgacggatatgctgaaaacagtactaacatttggtactggtactaaagcagctatccctggtgttgcacaagctggtaagactggtacttccaactatacggaagatgagttagctaaaattgaagcaactactggtatctacaatagcgccgttggtacaatggctcctgatgaaaactttgtcggctatacttctaagtacacaatggcaatttggactggttataaaaatcgccttacaccactttatggtagccaactggatattgctactgaggtttatcgtgcaatgatgtcctacctaactggcggatacagtgcagattggacaatgccagaagggctctatcgaagcggaagctacttgtatatcaatgggacaactacaaccggcacttactcttcttctgtctataagaatatctatcaaaattctggacagtcaagtcaaagcagtagttcaacatcctctgagaaacaaaaagaggataagaatacagcaaatgatgccaattcatcatccccacaagtcgaaacacctaataatggtaatgctactacccctaataattccaatcaaactgtgccaggaactggacatggtaatggtaatggtaatggtaacaacaatacagtacctaacggtaat

SEQ ID NO: 9534 - protein, 730 aa, Streptococcus agalactiae
MGFIILAIVIGGLLFAYYVSRSPKLTDQALKSVNSSLVYDGNNKLIADLGSEKRESVSADSIPLNLVNAITSIEDKRFFKHRGVDIYRILGAAWHNLVSSNTQGGSTLDQQLIKLAYFSTNKSDQTLKRKSQEVWLALQMERKYTKEEILTFYINKVYMGNGNYGMRTTAKSYFGKDLKELSIAQLALLAGIPQAPTQYDPYKNPESAQTRRNTVLQQMYQDKNISKKEYDQAVATPVTDGLKELKQKSTYPKYMDNYLKQVISEVKQKTGKDIFTAGLKVYTNINTDAQKQLYDIYNSDTYIAYPNNELQIASTIMDATNGKVIAQLGGRHQNENISFGTNQSVLTDRDWGSTMKPISAYAPAIDSGVYNSTGQSLNDSVYYWPGTSTQLYDWDRQYMGWMSMQTAIQQSRNVPAVRALEAAGLDEAKSFLEKLGIYYPEMNYSNAISSNNSSSDAKYGASSEKMAAAYSAFANGGTYYKPQYVNKIEFSDGTNDTYAASGSRAMKETTAYMMTDMLKTVLTFGTGTKAAIPGVAQAGKTGTSNYTEDELAKIEATTGIYNSAVGTMAPDENFVGYTSKYTMAIWTGYKNRLTPLYGSQLDIATEVYRAMMSYLTGGYSADWTMPEGLYRSGSYLYINGTTTTGTYSSSVYKNIYQNSGQSSQSSSSTSSEKQKEDKNTANDANSSSPQVETPNNGNATTPNNSNQTVPGTGHGNGNGNGNNNTVPNGN

SEQ ID NO: 9535 - DNA, 330 bp, Streptococcus agalactiae
atggcaagtattatttatagcccaaaagatatttttgagcaagattttaaagttagtatgcggggatatgacaagaaagaagtcgatgtatttctggatgatgtcatcaaagattacgaaaattatcttgagcaaattgagaagctccaaatggaaaatagacgtctacaacaagctttagacaaaaaagaaagcgaagcttcaaatgtaagaaattcagggacagctatgtataatcaaaaaccgattgcccaatctgcaaccaattttgatattttaaaacgcattagccgccttgagaaagaagtttttggaagacaaattagagaa

SEQ ID NO: 9536 - protein, 110 aa, Streptococcus agalactiae
MASIIYSPKDIFEQDFKVSMRGYDKKEVDVFLDDVIKDYENYLEQIEKLQMENRRLQQALDKKESEASNVRNSGTAMYNQKPIAQSATNFDILKRISRLEKEVFGRQIRE

SEQ ID NO: 9537 - DNA, 906 bp, Streptococcus agalactiae
atgattgcctggtctacaatgttgacatatattttctacatgacaatttttataaatagtggtttcatctggtatatttactttctgagtaatttactcgtctatcgctttagagataaattgaagtcttttagattcattagttttgcttgtactctagccacagtggtatttttatgcttctttaaggcatcagactttggtgatagaatcatgtttctaattgttcctattttttgtatcggttacatgtggattgctattgaaaatagaaatagcgaagaacaaagagaaaaaattgcagagcaaaatcagtatatcaatattttgtcagctgaaaatgaacgtaaccgtatagggcgtgatttgcatgatagtttaggacatacatttgctatgatgacactaaagacagaactagcgttaaagttgttagaaaaaaggaactatgataaggtacaaaaagaactatcagaattaaatcatattagtcatcaatcgatgagtgaggtccgtcaaattgtttctaacctcaagtatcgtacagtagtggaagaaattgatgagttgtaccgcttgtttcaattatctaacattaagttaacagttgttaataagttagagacgtcacaactaagtccagtaacacaatctacaatcacaatgatattaaaggaattatccaataatattgttaagcatgctgaagctgatagcgtggagttgagtttagtaaggcaaggtgctactataaatattgagatgattgataatggttgtggttttacaaaccttgacggagatgagttgcatagtattcaagagagattaactatcgttgaagggacactaacgattttgtcccgaagtaaaccaactcatattcaggtggtattgaaagaggta

SEQ ID NO: 9538 - protein, 302 aa, Streptococcus agalactiae
MIAWSTMLTYIFYMTIFINSGFIWYIYFLSNLLVYRFRDKLKSFRFISFACTLATVVFLCFFKASDFGDRIMFLIVPIFCIGYMWIAIENRNSEEQREKIAEQNQYINILSAENERNRIGRDLHDSLGHTFAMMTLKTELALKLLEKRNYDKVQKELSELNHISHQSMSEVRQIVSNLKYRTVVEEIDELYRLFQLSNIKLTVVNKLETSQLSPVTQSTITMILKELSNNIVKHAEADSVELSLVRQGATINIEMIDNGCGFTNLDGDELHSIQERLTIVEGTLTILSRSKPTHIQVVLKEV

SEQ ID NO: 9539 - DNA, 1887 bp, Streptococcus agalactiae
atggcggatgtttatctagctcgagatctaattttagataatgaagaggtcgcaataaaagtattgcgaaccaattatcaaacagatcagattgcggttgctcgcttccagagagaagcacgagcaatggctgagctgacacatcctaatattgtcgctattcgtgatataggtgaagaagacggacagcagttcttagtaatggaatatgttgatggattcgatttaaaaaagtatattcaagacaatgcacccctatcaaataatgaagttgttcgaatcatgaatgaagtcctttcagccatgtcactggcacatcagaaaggtatcgtacaccgtgatttaaaacctcaaaatattttattaactaaaaaagggactgtaaaagttacagatttcggtattgcggtagcgtttgctgaaactagtttaacgcaaacgaattctatgttaggtagtgttcattatttatcgccagagcaggcgcgtggttcaaaagcgactgttcagagtgatatttatgccatgggaatcatgctttttgaaatgttaactggccatattccttatgatggggatagtgcagttactattgccctacagcacttccaaaaaccactaccatcaatccttgcagaaaataaaagcgttccacaagctttggaaaacattgtcattaaagcaacagctaaaaagctaacagatcgctataagacaacttatgagatgggacgtgatttatcaactgctctaagctcgacacgtcaccgtgaaccaaaacttgtttttaatgatactgagagtactaagacactacccaaagtaacatctacagtatcatctctaacgacagaacaactgttgcgtaatcaaaaacaggccaaaacaacagaaaaaataactcctgattctgcgagtaacgataaaacgaagtctaaaaagaaggcttctcatcgacttcttggtacaatcatgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacagtagtaacacctccatcttcaagtaagatagcaagtcaggatccttattacggaggagaagttggattaaggagaggagataaagttaagctgtatcttcttggttctaaaacaacgaataactcatcatctacgccaatagattcttcggcttcaagctcaacaggaacaactacctcggattctgtaagctcatcaacggatgctagcacttctgatagtagtagcacttctacaagtagttcaacactaccaagtgatagtacaactaatacaggaacagctaacaatccattaactcaa

SEQ ID NO: 9540 - protein, 629 aa, Streptococcus agalactiae
MADVYLARDLILDNEEVAIKVLRTNYQTDQIAVARFQREARAMAELTHPNIVAIRDIGEEDGQQFLVMEYVDGFDLKKYIQDNAPLSNNEVVRIMNEVLSAMSLAHQKGIVHRDLKPQNILLTKKGTVKVTDFGIAVAFAETSLTQTNSMLGSVHYLSPEQARGSKATVQSDIYAMGIMLFEMLTGHIPYDGDSAVTIALQHFQKPLPSILAENKSVPQALENIVIKATAKKLTDRYKTTYEMGRDLSTALSSTRHREPKLVFNDTESTKTLPKVTSTVSSLTTEQLLRNQKQAKTTEKITPDSASNDKTKSKKKASHRLLGTIMKLFFALCVVGIIVFAYKILVSPTTIRVPDVSNKTVAQAKMTLENSGLKVGAIRNIESDSVSEGLVVKTDPAAGRSRREGAKVNLYIATPNKSFTLGNYKEHNYKDILKDLQGKGVKKSLIKVKRKINNDYTTGTILAQSLPEGTSFNPDGNKKLTLTVAVNDPMIMPDVTGMTVGEVIETLTDLGLDADNLVFYQMQNGVYQTVVTPPSSSKIASQDPYYGGEVGLRRGDKVKLYLLGSKTTNNSSSTPIDSSASSSTGTTTSDSVSSSTDASTSDSSSTSTSSSTLPSDSTTNTGTANNPLTQ

SEQ ID NO: 9541 - DNA, 930 bp, Streptococcus agalactiae
atggaagggaaaagccaatctgagattgccaatgaattaggaatttatcgtacaacaataagtcgtatgttagccaaagcgagagaagaaggtcttgttagaatcgaaatttcagattttaatccagaaatttttcagttagaatcctattttaaaagtaaatatcaccttaaagatattgagattgtttcttcgcgaaaagatagcgatacttcagagatagagaaggatttagcacatgtagctgcagctatgattcgaaaaaaaattaaagagaatgacaaggtggggattgcttgggggaggacacttagtaaagtagttgaagcaatgcgtcctcatccggtttctcaagtttcttttgttcctttggccggaggtccaagtcatattaatgcacgctatcacgttaatactctggtttacgaaatgtcaaggcgtttccaaggaagttgtactttcattaatgcaactctagttcaagaaaacgctaatttagcgaaaggaatattaacttcaaaatattttgaggggctaatggataattgggaaaaacttgatgtggcaattgtgggcgttggtggtaaacctaaaagcaatgaacaacagtggcttgaccttttaaatcaagatgattttcaatgcttggatgaagaagcagctgtaggtgaaattacttgtcgtttttttaatcattcaggtgatcctgtgaatcaacatttagctaaaaggacaataggaattaccttagaacaactacagaaagttcctaatagaatagcggttgctcatggcaattataaggctgcggcactcttagccgttttaaaaaaggggtatattaatcatttagttactgatttttccacagccttaaatattttaagattagataaagacacctttgtggatactatatatcaaaagagc

SEQ ID NO: 9542 - protein, 310 aa, Streptococcus agalactiae
MEGKSQSEIANELGIYRTTISRMLAKAREEGLVRIEISDFNPEIFQLESYFKSKYHLKDIEIVSSRKDSDTSEIEKDLAHVAAAMIRKKIKENDKVGIAWGRTLSKVVEAMRPHPVSQVSFVPLAGGPSHINARYHVNTLVYEMSRRFQGSCTFINATLVQENANLAKGILTSKYFEGLMDNWEKLDVAIVGVGGKPKSNEQQWLDLLNQDDFQCLDEEAAVGEITCRFFNHSGDPVNQHLAKRTIGITLEQLQKVPNRIAVAHGNYKAAALLAVLKKGYINHLVTDFSTALNILRLDKDTFVDTIYQKS

SEQ ID NO: 9543 - DNA, 321 bp, Streptococcus agalactiae
atggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaa

SEQ ID NO: 9544 - protein, 107 aa, Streptococcus agalactiae
MEIIVADQIIMGLILNAGDAKQHIYQALKLAKEGNFAESKIEIELADSALLEAHNLQTQFLAQEAGGTRTDISALFIHSQDHLMTSITEINLIKEIIDLRQELHIQK

SEQ ID NO: 9545 - DNA, 1086 bp, Streptococcus agalactiae
atgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaa

SEQ ID NO: 9546 - protein, 362 aa, Streptococcus agalactiae
MKVFASPSRYIQGKDALFQSIEHIKSLGQTPLILCDDVVYNIVGERFLSYLQDDLLPHRVSFNGEASDNEINRVVAVAKEKNSDLIIGLGGGKTIDSAKAIADKVNLPVVIAPTVASTDAPTSALSVIYTDEGAFEKYIFYSKNPDLVLVDTQVIAQAPKRLLASGIADGLATWVEARAVLQKNGIAMAGGRQTLAGVAIAQACERTLFNDSLQALAACDAKVVTKALENVIEANTLLSGLGFESAGLAAAHAIHNGFTALSGDIHHLTHGEKVAYGTLTQLFLENRPKEEIDRYINLYQAIGMPTTLAELHLGDATYEELLKVGQQATIEGETIHEMPFKISAEDVAAALLTVDRYVSNHQ

SEQ ID NO: 9547 - DNA, 1209 bp, Streptococcus agalactiae
atgacagatgctttgatacaatattatcaaaattatattaacggtaaagatattgttaaagaccaaacttggattatcaatcgttatcaagaaattattagtgatttgtctttaggaagcactattgcagaagaaattactcgctctatagagcagctagcttcacttcccatagaaaataatcagtttttatatgattgttttttagcagccggtgaagataacaacgcaaagttagttgcaacgttttttaatcaaaatgacattcctgcaagatatgttcatccaaacgaagcaggaattattgtaactaaagaaccatgtaatgcacgaattattccaggaagttatgataagattgagaacttatgtctatacaatgaggttcttgttatccctggattttttggagtcacagaagataaccaaatttgtaccttttcaagagggggatctgacattactggatccctaattgcagcaggcataaaagcagacctttatgagaacttcacagatgttgatggtatatttgcagcacatccaggtgtagttaagaaccctcacgctatccctgagcttacttataaagaaatgcgtgaattagcctatgcgggtttttcggttttacatgatgaagctttacttcctgcctatcgtggcagaatccctcttgttattaaaaatacaaataatccccaacagcctggtacaaaaatagttttaaagcatactcgtagtaacatagcagtaactgggatcgcttctgatagccgttttgctagcataaacgtatctaaatacttaatgaatagagaagtaggtttcggccgaaaagtactacaaattttagaggatttaaatattagttttgaacatatgccaactggcatagatgatctatccattgtcttacgtgaaaaagaattgacaccaatcaaagaacaagaaatcttaaattacctaactcgtaaactagaagtagattacgttgacatccaacacaatctatctacaatcgtaattgtaggtgaaaatatgaaaagtcagattggagtcactgcaacagcgacacaagccttatcaagagaaaaaatcaatatcaccatgatatcacaaggttcaagcgaagtctccattatgttcgttataaacagtaaggatgaaaaaagagctattaaagcactatatgaaacattcttccaaaaa

SEQ ID NO: 9548 - protein, 403 aa, Streptococcus agalactiae
MTDALIQYYQNYINGKDIVKDQTWIINRYQEIISDLSLGSTIAEEITRSIEQLASLPIENNQFLYDCFLAAGEDNNAKLVATFFNQNDIPARYVHPNEAGIIVTKEPCNARIIPGSYDKIENLCLYNEVLVIPGFFGVTEDNQICTFSRGGSDITGSLIAAGIKADLYENFTDVDGIFAAHPGVVKNPHAIPELTYKEMRELAYAGFSVLHDEALLPAYRGRIPLVIKNTNNPQQPGTKIVLKHTRSNIAVTGIASDSRFASINVSKYLMNREVGFGRKVLQILEDLNISFEHMPTGIDDLSIVLREKELTPIKEQEILNYLTRKLEVDYVDIQHNLSTIVIVGENMKSQIGVTATATQALSREKINITMISQGSSEVSIMFVINSKDEKRAIKALYETFFQK

SEQ ID NO: 9549 - DNA, 585 bp, Streptococcus agalactiae
gtgatgaaagctgctgttgagagcgatgatattagctcattaactaaaattgctgagttagttaatcagatatcgtatgatttactacagctagagaaacctgttgttatgtgtgtagatggggctgtagctggtgccgcagctaatattgcattagcagctgattttgttatcgcaagcaagaagagtaaatttatccaggcttttgtgggtgtcggtttagctccagatgcaggaggtttattgttacttagtaaatcaatcggtataactcgtgcagtgcaactagctttaactggagaaagcttatctgctgaaaaagctgaagctttgggaattgtttataaactttgtgaatcagataaaataggtaaaattaaggatcaactattaaagcgtttaagtagacattctataaactcatatcaagccataaaatcattagcttgggaagctgcttttaaagattgggaacaatataaaaagcttgaattacaactgcaagaatcattagcctttaagcaagattttaaagaaggtgttcgggcacacgctgatagaaggcgtcctaattttttaggcaaa

SEQ ID NO: 9550 - protein, 195 aa, Streptococcus agalactiae
MMKAAVESDDISSLTKIAELVNQISYDLLQLEKPVVMCVDGAVAGAAANIALAADFVIASKKSKFIQAFVGVGLAPDAGGLLLLSKSIGITRAVQLALTGESLSAEKAEALGIVYKLCESDKIGKIKDQLLKRLSRHSINSYQAIKSLAWEAAFKDWEQYKKLELQLQESLAFKQDFKEGVRAHADRRRPNFLGK

SEQ ID NO: 9551 - DNA, 222 bp, Streptococcus agalactiae
atggcagtatttgaaaaagtacaagaaattattgttgaagaacttggtaaagatgcagaagaagtaacgttgaacactacttttgacgatcttgatgctgattcgcttgatgttttccaagtgatttcagaaattgaagatgcatttgatatccaaattgagacagaagaaggactaaatactgttggtgatttagttgcttatgttgaagaaaaagtaaaa

SEQ ID NO: 9552 - protein, 74 aa, Streptococcus agalactiae
MAVFEKVQEIIVEELGKDAEEVTLNTTFDDLDADSLDVFQVISEIEDAFDIQIETEEGLNTVGDLVAYVEEKVK

SEQ ID NO: 9553 - DNA, 498 bp, Streptococcus agalactiae
ttggatattcaagagattaaggatttaatgactcaatttgatgagtcaagtctgagagaattttcattcaaaacaagtgacggtgagctgtcttttagtaaaaatgagggaaaagctccacttgtcccaactatgtctcctatgagtcatcaacctgaagcgactccaactatagcaactcctgtctctaatgaagcaggtgagcaaacgaaacaagctactgaagtagtttcagaaatcccagagtcgactgtgactgttgcagaaggtgacgttgtcgaaagtcctttagttggggttgcttatttagcttctggaccagataaacctaactttgtttcagtaggtgatagcgtgaagaagggacaaactttgatgattattgaggcaatgaaggtgatgaatgaagtgcctgccccccatgatggtgtagttactgaaattcttgtagccaatgaagaagttattgaatttggtaaaggattggtacgaatcaaa

SEQ ID NO: 9554 - protein, 166 aa, Streptococcus agalactiae
MDIQEIKDLMTQFDESSLREFSFKTSDGELSFSKNEGKAPLVPTMSPMSHQPEATPTIATPVSNEAGEQTKQATEVVSEIPESTVTVAEGDVVESPLVGVAYLASGPDKPNFVSVGDSVKKGQTLMIIEAMKVMNEVPAPHDGVVTEILVANEEVIEFGKGLVRIK

SEQ ID NO: 9555 - DNA, 615 bp, Streptococcus agalactiae
ttggcagggcgtcctgtgacgattgtcggtattcaaaaaggtaagaaccttcaagataatttagaccgtcattttggtcaaccacatcctgaaggttatcgtaaggctttacgtttaatgaaacaagctgagaagtttggaagacctgttataaccttcatcaatactgctggagcatatcctggggtaggtgctgaggagcgaggtcagggtgaagcaattgctagaaacctcttagaaatgagtgatttaaaagtccctattatagctattattattggtgaagggggttctggaggagcattagctttagctgttgccgataaggtttggatgttggaacatactgtttattctattttaagtcctgagggctttgcctctattttatggaaagatggtacaagaacaacagaagcagcacaattaatgaagatgactgctggagaactttaccatatggaagttgtagacaaagtaatccctgaacatggttatttttcaagtgagattgtcgatatgattaagacaagtttaatttcagagttagaagtgctctcacaattatctcttgaggatttattggaacaacgttaccaacgttttagaaaatat

SEQ ID NO: 9556 - protein, 205 aa, Streptococcus agalactiae
MAGRPVTIVGIQKGKNLQDNLDRHFGQPHPEGYRKALRLMKQAEKFGRPVITFINTAGAYPGVGAEERGQGEAIARNLLEMSDLKVPIIAIIIGEGGSGGALALAVADKVWMLEHTVYSILSPEGFASILWKDGTRTTEAAQLMKMTAGELYHMEVVDKVIPEHGYFSSEIVDMIKTSLISELEVLSQLSLEDLLEQRYQRFRKY

SEQ ID NO: 9557 - DNA, 630 bp, Streptococcus agalactiae
atgtatcaagaattaaatgattatttagaattccaatcaatgaagtatattatgcctgagaaggcaggcgctttaaaggacgatatgcaaacttttaaggcaaagggccaacttgctaggaatagctttacagagttatcaagagccttagaacaacgtatggatggctttaaaatgcaaagagtgagtaattgggctaatcaagctcaagtagggcgtccacatttttgggtttattatcgaaaggatacagaccaattagatgatgtggctgttgcgctaagggtttatggtgtaaaagatagttttggggttagccttgaggtaagctttgtagagaggcaaaaatctgataagacactcgagaagcaggctagagtgttatcgattccgattgcctctccattgtattttatggtccaaaggcaaggtgaaactcatcgagaagaaggcaatgaggaaaatcgtcaacgtttaatgcaagaaattaagtcagggaaggtaaggaaagtattggtaaaatatgacgttcttttgactgaaaaccagagcttagaaaatattctgcaacgattgttagaaggctttgagaaagtgttaccttactatcaagtttgtcaaactattagc

SEQ ID NO: 9558 - protein, 210 aa, Streptococcus agalactiae
MYQELNDYLEFQSMKYIMPEKAGALKDDMQTFKAKGQLARNSFTELSRALEQRMDGFKMQRVSNWANQAQVGRPHFWVYYRKDTDQLDDVAVALRVYGVKDSFGVSLEVSFVERQKSDKTLEKQARVLSIPIASPLYFMVQRQGETHREEGNEENRQRLMQEIKSGKVRKVLVKYDVLLTENQSLENILQRLLEGFEKVLPYYQVCQTIS

SEQ ID NO: 9559 - DNA, 990 bp, Streptococcus agalactiae
atgttcatgattgttattacgcatgttcttggaaaaggtggtctgagatcttcggttgagggacacgcagactcctattttatagtaacgtggattatccaagtcttagtttatggggccgttaactgttacgcactaataagtggttatgtgggaattaattcgcgttatcgttactcaaaattactgtctatctgggcacaggtttttttctacacctttacaataacagcactttttgcaatcacaggtcatgaagtgaccttgcttaattggagagatgcttttttccctattgtcagtgggcagtattggtacattactgcttactttggtctattggtttttatgcctgttattaataatggattaaatgccttgactgataaacaattaaaacaattggttttgttaatgtttattattttttcaattttaccagctgttttaaataatcgtgttccagaattttcattgagcaagggttttgaaatgacttggctactgattttatatattattggtgcctatttgaaacgtattgatttaaatatatttaaaacgtcatatttacttataatttatctattatcattggttgctacttatgccatgaagtttagcgttggtgatatttggtattggtatgtttcgcctactttaactttaggggcggtaagtttgtttatattatttgctagagcaagcattaagccctcgggattcttaaagaaaataattgttgtattagccccttcaaccttgggagtttatctctgtcatctccacccactaatagtaaaatattttgtaagagattttgcagagacgtttgtttatgagtccatttatctttacccatttttaattttaggagcagggattttaatttatttgttggcttttattgtagaacgtattagattacgaatatttaaagcaatccatttttctaactttttgagatggtttgatgacaagttcccatat

SEQ ID NO: 9560 - protein, 330 aa, Streptococcus agalactiae
MFMIVITHVLGKGGLRSSVEGHADSYFIVTWIIQVLVYGAVNCYALISGYVGINSRYRYSKLLSIWAQVFFYTFTITALFAITGHEVTLLNWRDAFFPIVSGQYWYITAYFGLLVFMPVINNGLNALTDKQLKQLVLLMFIIFSILPAVLNNRVPEFSLSKGFEMTWLLILYIIGAYLKRIDLNIFKTSYLLIIYLLSLVATYAMKFSVGDIWYWYVSPTLTLGAVSLFILFARASIKPSGFLKKIIVVLAPSTLGVYLCHLHPLIVKYFVRDFAETFVYESIYLYPFLILGAGILIYLLAFIVERIRLRIFKAIHFSNFLRWFDDKFPY

SEQ ID NO: 9561 - DNA, 300 bp, Streptococcus agalactiae
atggggaataaagttggaaaatttttagttggtgaccaggcattagaattctataacgataaaaatgtcaacgactatattcaaattccatggacatcaatcaatcaaattggagctaatgttagtcgaaaaaaaattagtcgtcactttgaggtctttacagaccaaggaaaatttttattcgcctctaaagactctggaacgatattaaagcatgcgagacgacatattggagacgataaagttgttaagcttcctaccctcatccagaccattttaaaaatattcaagtttaaaaaa

SEQ ID NO: 9562 - protein, 100 aa, Streptococcus agalactiae
MGNKVGKFLVGDQALEFYNDKNVNDYIQIPWTSINQIGANVSRKKISRHFEVFTDQGKFLFASKDSGTILKHARRHIGDDKVVKLPTLIQTILKIFKFKK

SEQ ID NO: 9563 - DNA, 723 bp, Streptococcus agalactiae
atgttaaaaattgaaaatgttacaggggggtatgttaatatcccagttttaaaaaatatttcttttgaagtaaatgatggagagttagttggattaattgggcttaatggtgcaggaaaatcaaccactattaacgagattattggtattttgagaccctatcaaggagatattacaattgatggtattagtcttgaagccgaccaagaactttatagaaagaaaataggctttattcctgagacaccaagtctctatgaggagctaactctcagggaacatttagaaacggtagctatggcgtatgatattgccaccgatgaagttatggcacgtgcgcaaaaactattagagatgtttcgtctaacagataaattagactggtttccaatgcatttttcaaagggaatgaaacaaaaggttatgattatttgtgcttttgttgtatctccaagtttatttattgttgatgaaccatttttaggtttggatccactagctatttcagatttgattaatcttctagcagaagaaaaagctaaagggaaatctattttgatgtcaacacacgtattagattctgccgaaaaaatgtgtgatcgttttgttattttacataaaggagaaatacgggcagttggaaccctagaggaattacgggctatttttggagacagtaatgctaatttaaatgacatctacatagctctgacaaaagaggtg

SEQ ID NO: 9564 - protein, 241 aa, Streptococcus agalactiae
MLKIENVTGGYVNIPVLKNISFEVNDGELVGLIGLNGAGKSTTINEIIGILRPYQGDITIDGISLEADQELYRKKIGFIPETPSLYEELTLREHLETVAMAYDIATDEVMARAQKLLEMFRLTDKLDWFPMHFSKGMKQKVMIICAFVVSPSLFIVDEPFLGLDPLAISDLINLLAEEKAKGKSILMSTHVLDSAEKMCDRFVILHKGEIRAVGTLEELRAIFGDSNANLNDIYIALTKEV

SEQ ID NO: 9565 - DNA, 1137 bp, Streptococcus agalactiae
atgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaa

SEQ ID NO: 9566 - protein, 379 aa, Streptococcus agalactiae
MLEAFRILEEEKHINKEDIIDAVTESLKSAYKRRYGQSESCVIEFNEKKADFTVYTVREVVDEVFDSRLEISLKDALAISSAYELGDKIRFEESVTEFGRVAAQSAKQTIMEKMRRQMREVTFNEYKQHEGEIMTGTVERFDQRFIYVNLGSLEAQLSHQDQIPGESFKSHDMIDVYVYKVENNPKGVNVFVSRSHPEFIKRIMEREIPEVFDGTVEIMSVSREAGDRTKVAVRSHNSNVDAIGTIVGRGGSNIKKVISNFHPKRVDAKTGLEIPVEENIDVIQWVEDPAEFIYNAIAPAEVDMVLFDDEDTKRATVVVPDSKLSLAIGRRGQNVRLAAHLTGYRIDIKSASEYEKMEAQELQTEEVAQESEVISDKAE

SEQ ID NO: 9567 - DNA, 348 bp, Streptococcus agalactiae
atggctaatcatcgtattgatcgcgttggaatggaaattaaacgtgaagtcaatgagattttgcgtctccgagttaatgatccacgtgtacaagatgtcacaattactgatgttcagatgttgggtgacctttcaatggctaaagtattttatactattcattcgacacttgcttctgataatcaaaaagcacaaattggtttagaaaaagcaactggtactattaagcgtgaacttggcaaaaaccttactatgtataaaataccagatttacaatttgttaaagatgaatctattgaatacggaaataagattgatgaaatgttgcgcaatctagataaaaaagat

SEQ ID NO: 9568 - protein, 116 aa, Streptococcus agalactiae
MANHRIDRVGMEIKREVNEILRLRVNDPRVQDVTITDVQMLGDLSMAKVFYTIHSTLASDNQKAQIGLEKATGTIKRELGKNLTMYKIPDLQFVKDESIEYGNKIDEMLRNLDKKD

SEQ ID NO: 9569 - DNA, 810 bp, Streptococcus agalactiae
atgataaaattaattgctattgatatggatggaacgcttttaaatgatgaaaagaaaattccaaaggaaaatatccaagctattaaagaagcaactcaagcaggtattaaaattgtactgtgtactgggcgaccgatgtcaggtatacttccttattttaatgaactaggtttaacaaaagaggagtatattatcatgaataatggttgtagcacttatagcacgaaagattggcaattgattgattctgcaactttaacacatgatgaactcatctttcttgaggaggttgttaaagaatttcccaacgtttgtttaacattaacagctgaaaatacattttacgctgttggagaggaagttcctgaaattgttgcttatgatgctgatttagtttttacaaaagcaaagtcaacaagtttagatgctcttcgcaatcaagaagaaattgtctttcaagcaatgtacatgggattagatgcagatgtaactgcttttcaagaagctgttgaagaagccttaatctcgaaatttagtggagttcgaagccaagactatatttatgagattatgcctcaaggagtaacaaaagcaagaggcttaaaatccttgatagcaaaattaggactggatattaatcaagttatggccatcggtgatgctcctaacgatattgaattattagatttagttcccaatagcgttgctatggggaatgcatcagatgagattaaatctagatgtaaatatataacggtggataataacaaagcaggggttgctaaagctatttatgactatgctttacgt

SEQ ID NO: 9570 - protein, 270 aa, Streptococcus agalactiae
MIKLIAIDMDGTLLNDEKKIPKENIQAIKEATQAGIKIVLCTGRPMSGILPYFNELGLTKEEYIIMNNGCSTYSTKDWQLIDSATLTHDELIFLEEVVKEFPNVCLTLTAENTFYAVGEEVPEIVAYDADLVFTKAKSTSLDALRNQEEIVFQAMYMGLDADVTAFQEAVEEALISKFSGVRSQDYIYEIMPQGVTKARGLKSLIAKLGLDINQVMAIGDAPNDIELLDLVPNSVAMGNASDEIKSRCKYITVDNNKAGVAKAIYDYALR

SEQ ID NO: 9571 - DNA, 438 bp, Streptococcus agalactiae
atggtttatcattttcaaaatccaagtgattttatgttaaaaaattatttaacaaaagcaaagaccatcgcagttgtaggactgtcagaccgtcaagaaactgcagcttatcaagtatcaaaaataatgcaagaagcaggttatcaaattattccagttaatcctaaaaatgcaggacagaaaatacttgggcaaatgacatatgcctcacttaaggatgtcactgaacatattgatattgttaatatttttcgacgtagcgagtatttacctgatattgcaagagaatttttagaagtagacgctgatattttctgggctcagcttggacttgaaagtcaagaagcagagacaattctaaagcaagcaggacacaaacagattgtcatgaataaatgtctgaaagttgaatgccaaaaattacactcagaaactaac

SEQ ID NO: 9572 - protein, 146 aa, Streptococcus agalactiae
MVYHFQNPSDFMLKNYLTKAKTIAVVGLSDRQETAAYQVSKIMQEAGYQIIPVNPKNAGQKILGQMTYASLKDVTEHIDIVNIFRRSEYLPDIAREFLEVDADIFWAQLGLESQEAETILKQAGHKQIVMNKCLKVECQKLHSETN

SEQ ID NO: 9573 - DNA, 477 bp, Streptococcus agalactiae
atggacagtcattcacatggtcatagacctctcgatgcttatgaaaacgtcctagagcatctccgtgaaaaacgtattcgaattactgagactcgaaaagctattatttcctatatggttaatagtcgtgagcatccgagtgcagaaaagatttacaatgatttattaccagaatatcctaacatgagcttggcaacagtttacaataaccttaaggtccttgtggatgaggggtttgtgacagagctaaaactttgcaattatagtacaacttattatgattttatggggcatcagcacctaaacattgcctgtgaagattgtgggaaaatcgttgattttgtcgatgttgacttattggatatttctagagaagcacaccaacaaacaggttttgaagtgactagagttcagttagtagcttatggtatctgtccggagtgtcagaggaagcgtaaggataaatataaaaaagat

SEQ ID NO: 9574 - protein, 159 aa, Streptococcus agalactiae
MDSHSHGHRPLDAYENVLEHLREKRIRITETRKAIISYMVNSREHPSAEKIYNDLLPEYPNMSLATVYNNLKVLVDEGFVTELKLCNYSTTYYDFMGHQHLNIACEDCGKIVDFVDVDLLDISREAHQQTGFEVTRVQLVAYGICPECQRKRKDKYKKD

SEQ ID NO: 9575 - DNA, 738 bp, Streptococcus agalactiae
atgacgaattcagaaattaaaaatgaggcaaaaactatattaagcaatcttcaaggtaagaatcaactttttttactcccgattctccttagtattattacgttatatatatcattttattatcaatataataatatgacactacttgatttttttgtacctcttccagtttatttcttttacacactttttattatttcagtcagttttgtaatgttagatgtcgtcaaaaatcagaaactaaacgttagattctcggacaatacttatgtattttcaagccatattttctggaaattactctcagtacttgttctaaaaggactaattttatctttcttttatctactaagtacttttggtctactaatcatcatttcaagttttaggctacttttgagtggtaaccttatccttgcccctgttttaatagttgttagtagcctaattactactaaggcagttataaaactcgttcaacaatattactcctatagtatctcaactttagtattttacactcaattagaaagtggaaactatgagggaccgtctaaagtactggttgctagtcgagaactaatgaatggtaataaacttagactcttccttttagacttaagttttattggttggcagttccttacaatcttcagtttcggattagtctatatctatctccttccttaccaaactactgcgcgcttaatcttttatagaaacattacaaaaaatagc

SEQ ID NO: 9576 - protein, 246 aa, Streptococcus agalactiae
MTNSEIKNEAKTILSNLQGKNQLFLLPILLSIITLYISFYYQYNNMTLLDFFVPLPVYFFYTLFIISVSFVMLDVVKNQKLNVRFSDNTYVFSSHIFWKLLSVLVLKGLILSFFYLLSTFGLLIIISSFRLLLSGNLILAPVLIVVSSLITTKAVIKLVQQYYSYSISTLVFYTQLESGNYEGPSKVLVASRELMNGNKLRLFLLDLSFIGWQFLTIFSFGLVYIYLLPYQTTARLIFYRNITKNS

SEQ ID NO: 9577 - DNA, 1140 bp, Streptococcus agalactiae
atgactgatcatccaataaaatatcgattaattaaacaggaaaaacacacaggagccagacttggtgaaataatcacaccacatggtacatttccgacaccaatgtttatgcctgttgggacacaagcaactgttaagacacaatctcctgaagaactaaaagaaatgggttcaggaattattctatcaaatacctaccatttatggttacgtccaggtgatgaattgattgctaaagctggaggtttacataaattcatgaactgggatcaggctattctaacagacagtggaggctttcaggtttattctttggctgatagtcgaaacatcactgaagaaggagtaacctttaaaaaccatttaaatggtgcgaaaatgtttttatcaccagaaaaagctatttcaattcaaaataaccttggttctgatattatgatgagttttgatgagtgtccacaattttaccagccttatgattatgtaaaaaaatcaattgagcgaacaagccgttgggcagaacgtggattaaatgcccaccgccgtcctcatgatcaaggactatttggtattgttcaaggggcagggtttgaggatttacgtcgtcaatcagcacgagatttagtatcgatggattttccaggttattcaattggagggcttgcggtcggagaaacacatgatgagatgaatgcagttcttgattttactgttccaatgcttccgaatgataagcctcgttatttgatgggagttggtgcaccagatagtttaatagacgccgttatccgaggagtagatatgtttgattgcgtcttacctactcgtattgctcgaaatgggacatgtatgacaagtcaaggtcgcttagttgttaagaatgctaaatttgcagaagattttacgcctcttgatccaaattgcgattgctatacttgtaaaaattatacacgcgcttatattcgtcacttattgaaagcagatgaaacttttggtattcgtttgactagttaccataatctttatttccttgtcaatcttatgaaagatgtcagacaagctattatggatgataatcttctagaattccgtcaagattttatggagcgctatggctatggcatgaataaccgtaatttt

SEQ ID NO: 9578 - protein, 380 aa, Streptococcus agalactiae
MTDHPIKYRLIKQEKHTGARLGEIITPHGTFPTPMFMPVGTQATVKTQSPEELKEMGSGIILSNTYHLWLRPGDELIAKAGGLHKFMNWDQAILTDSGGFQVYSLADSRNITEEGVTFKNHLNGAKMFLSPEKAISIQNNLGSDIMMSFDECPQFYQPYDYVKKSIERTSRWAERGLNAHRRPHDQGLFGIVQGAGFEDLRRQSARDLVSMDFPGYSIGGLAVGETHDEMNAVLDFTVPMLPNDKPRYLMGVGAPDSLIDAVIRGVDMFDCVLPTRIARNGTCMTSQGRLVVKNAKFAEDFTPLDPNCDCYTCKNYTRAYIRHLLKADETFGIRLTSYHNLYFLVNLMKDVRQAIMDDNLLEFRQDFMERYGYGMNNRNF

SEQ ID NO: 9579 - DNA, 327 bp, Streptococcus agalactiae
ttgaaaaaaacctatcgggtaaaaagtgataaggattttcaaatgattttcagcagaggtaaaaatgttgctaatcgaaaatttgttatctactatttagaaaaagaacaaaaacactttcgtgtgggaatctctgttagtaagaaattaggaaatgctgttgttcgtaacgctattaaaagaaaaattaggcatgttttactctctcagaaaacagcgctgcaagattatgattttgtcgtgattgcgcgtaaaggtgtagaggaattggactatcaagcattagaaaaaaatcttatacacgttttaaaaatagcaggactcatc

SEQ ID NO: 9580 - protein, 109 aa, Streptococcus agalactiae
MKKTYRVKSDKDFQMIFSRGKNVANRKFVIYYLEKEQKHFRVGISVSKKLGNAVVRNAIKRKIRHVLLSQKTALQDYDFVVIARKGVEELDYQALEKNLIHVLKIAGLI

SEQ ID NO: 9581 - DNA, 3699 bp, Streptococcus agalactiae; identical to SEQ ID NO: 8525

SEQ ID NO: 9582 - protein, 1233 aa, Streptococcus agalactiae
MDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 9583 - DNA, 906 bp, Streptococcus agalactiae
atgaaaacgataaaagattggcaaataaatatttgcttagcgacctataatggtcaaaaataccttcgccagcaattagatagcataatacaacaaggttatactgactggatttgtttaataagggacgatggatctactgatgatacagtagctattattaaagaatatgttaatagagattcacgttttatatttattaattctaacgatgacagaaagttaggaagtcaccgcagtttttacgagttggttaactataaaaaagcagatttttatgttttctcagaccaggatgatgtttggaaagaaaatcgtttagaacgttaccttgaagaagcagagaaatttaaccaagaactaccattgcttgtttattcgaactggacttctgtagatgaaaaattaacagtattgaaagaacataatccagcaacagttattcaagaacaaattgcctttaaccaaataaatggtatggttatcatgatgaatcatgagttagcaaagctttgggaatatcgtcaaattggcgcccatgattcttatgttggaactctagcttacgccgttggaaatgtggcttatatttctgacagtacagtcctttggcgtagacaagtaggggcagagtcgctaaacaattacgggagacaatatggggtggctacgttttggcagatgataaatacttcttttgatcgtgcttcgcttatttttgctcaagtatccgataaaatgtccctggagcgtaaactcttctttagtcgttttatagaattaaaaaatgccaatctaatgagaaggatttatcttttatcaaaattaaaactccgtcggaaatcattgaaagaaacagttgctatgactatcctacttttaacaggttacggtaaaccaaaagca

SEQ ID NO: 9584 - protein, 302 aa, Streptococcus agalactiae
MKTIKDWQINICLATYNGQKYLRQQLDSIIQQGYTDWICLIRDDGSTDDTVAIIKEYVNRDSRFIFINSNDDRKLGSHRSFYELVNYKKADFYVFSDQDDVWKENRLERYLEEAEKFNQELPLLVYSNWTSVDEKLTVLKEHNPATVIQEQIAFNQINGMVIMMNHELAKLWEYRQIGAHDSYVGTLAYAVGNVAYISDSTVLWRRQVGAESLNNYGRQYGVATFWQMINTSFDRASLIFAQVSDKMSLERKLFFSRFIELKNANLMRRIYLLSKLKLRRKSLKETVAMTILLLTGYGKPKA

SEQ ID NO: 9585 - DNA, 396 bp, Streptococcus agalactiae
atgatacttgctggagtaactttagaaaatgtaaagtcaaatcaagaaggtatccagcaagccattggcatttgtaaaacacaacctgattttcgtttcgattacagtgccacttatcaagtagagacaagtgtccaagccccaaaagggttagaaattattaggatcccaagcgctacctatgcagtcatttctgttaaaggtccaatgccatcgagtcttcaagaaacatggcgaaaaataatacaaggattttttcaagagaataatctaaaaccagctaactcgccaaacttagaaatttattcatctcaacatccacaagatactgattatcaaatggaaatttggcttgctatcgcagatattactaataactcgaaaacaaacttaatc

SEQ ID NO: 9586 - protein, 132 aa, Streptococcus agalactiae
MILAGVTLENVKSNQEGIQQAIGICKTQPDFRFDYSATYQVETSVQAPKGLEIIRIPSATYAVISVKGPMPSSLQETWRKIIQGFFQENNLKPANSPNLEIYSSQHPQDTDYQMEIWLAIADITNNSKTNLI

SEQ ID NO: 9587 - DNA, 522 bp, Streptococcus agalactiae
atggtaaaagatagacaaattcagaaaacaaaagtagcgatttataatgcttttataagcttgctacaggaaaatgattattctaaaataacggttcaagatgtaatcggacttgcaaatgtaggaagatcaactttttactctcactatgaaagcaaagaagtgttactcaaggagctctgtgaagacctttttcaccacttatttaagcagggtagagatgttacgtttgaagagtatttagttcatatcttaaaacattttgaacaaaatcaagatagtatcgctacgttattattatctgacgatccctattttttattacgctttagaagtgaattagaacacgatgtttaccctagattgcgtgaggagtatattacaaaggtggacattcctgaagatttcttaaaacaatttcttttatccagttttatcgagaccttaaagtggtggcttcatcaaagacagaaaatgactgttgaagatttactaaaatattatttaactatggtagagagg

SEQ ID NO: 9588 - protein, 174 aa, Streptococcus agalactiae
MVKDRQIQKTKVAIYNAFISLLQENDYSKITVQDVIGLANVGRSTFYSHYESKEVLLKELCEDLFHHLFKQGRDVTFEEYLVHILKHFEQNQDSIATLLLSDDPYFLLRFRSELEHDVYPRLREEYITKVDIPEDFLKQFLLSSFIETLKWWLHQRQKMTVEDLLKYYLTMVER

SEQ ID NO: 9589 - DNA, 1191 bp, Streptococcus agalactiae
atgattgattttctactgttgaaatcattacacagtcttctaggtctaactattactgtttgtgatcaaaatttttctgttatcagagagtataaatccgagaaaactatttcacttttttacaatcattaccttattttaagtaactttagtaaaactcaacatgattttttatttcattatggctctttaggagaactttttcttgtccaccatattcaacaatattatattatcatcggtccctggcgtagcaatgttattgaccctttacttcttaagaaaaagctgactgaaacacaaatcaatgctagtgaacaagactactttattgatagactatcccaattacctttcttctcacttagtcaaatccgagaattactaatagtaaccaattattgtctaactggggttgtgaaagataaattatcagagcccttacattactacacgaaagggtggagcaactcctttgatctagataaaattaagcaattttctaaacagaatatgagttcttacaaatatcagtatcattttgaaaataatattctaaaagctgttaaatcaggtagtgaatttcttttgaaagaaacagtggaacaatttagcaattctatcgtacctataatcagtggagatgaattgcgatctgaaaaaaactactccatcatgatttatgatcgtctctcacaggctaccatccaagcaggacttgatatcgaaacagcttatcgagcacgagatcgttttataaaagaaaacgagtcaactataagtctaaatgaagttttaaaattacgtgatactgctatcttattctatactcaacaagttcattctttaaaaaaacatctcgaaacccctcattctcaaactattgtcgcagtgattcgatatcttgaaaataatctaaatcgctttattaaaacagaagaaatagctaaagaatgtcacatgagtgaatcgaagttacgaaaactatttaagcaagaaaaacacatcactattcaacaatattttctaaacttaaaaatcgaagctgctaagcaattactagatgaaaataagaaagtagaagaagtttccaatttacttggattttccacttcttctaatttttcaaggacatttaaaaaaatagtgggaattagcccactagaatataagcaaaagcctaagacaata

SEQ ID NO: 9590 - protein, 397 aa, Streptococcus agalactiae
MIDFLLLKSLHSLLGLTITVCDQNFSVIREYKSEKTISLFYNHYLILSNFSKTQHDFLFHYGSLGELFLVHHIQQYYIIIGPWRSNVIDPLLLKKKLTETQINASEQDYFIDRLSQLPFFSLSQIRELLIVTNYCLTGVVKDKLSEPLHYYTKGWSNSFDLDKIKQFSKQNMSSYKYQYHFENNILKAVKSGSEFLLKETVEQFSNSIVPIISGDELRSEKNYSIMIYDRLSQATIQAGLDIETAYRARDRFIKENESTISLNEVLKLRDTAILFYTQQVHSLKKHLETPHSQTIVAVIRYLENNLNRFIKTEEIAKECHMSESKLRKLFKQEKHITIQQYFLNLKIEAAKQLLDENKKVEEVSNLLGFSTSSNFSRTFKKIVGISPLEYKQKPKTI

SEQ ID NO: 9591 - DNA, 1362 bp, Streptococcus agalactiae
  misc_feature (1)..(1362): n = a, c, g, or t
atgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaannnnnt

SEQ ID NO: 9592 - protein, 454 aa, Streptococcus agalactiae
  MISC_FEATURE (1)..(454): Xaa = Any Amino Acid
MFRRSKNNSYDTLQTKQRFSIKKFKFGAASVLIGISFLGGFTQGQFNISTDTVFAAEVISGSAVTLNTNMTKNVQNGRAYIDLYDVKNGKIDPLQLITLNSPDLKAQYVIRQGGNYFTQPSELTTVGAASINYTVLKTDGSPHTKPDGQVDIVNVSLTIYNSSALRDKIDEVKKKAEDPKWDEGSRDKVLISLDDIKTDIDNNPKTQSDIANKITEVTNLEKILVPRIPDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKXX

SEQ ID NO: 9593 - DNA, 4167 bp, Streptococcus agalactiae
atgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggat

SEQ ID NO: 9594 - protein, 1389 aa, Streptococcus agalactiae
MFRRSKNNSYDTLQTKQRFSIKKFKFGAASVLIGISFLGGFTQGQFNISTDTVFAAEVISGSAVTLNTNMTKNVQNGRAYIDLYDVKNGKIDPLQLITLNSPDLKAQYVIRQGGNYFTQPSELTTVGAASINYTVLKTDGSPHTKPDGQVDIVNVSLTIYNSSALRDKIDEVKKKAEDPKWDEGSRDKVLISLDDIKTDIDNNPKTQSDIANKITEVTNLEKILVPRIPDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNGKGNKLPATGENATPFFNVVALTIMSSVGLLSVSKKKED

SEQ ID NO: 9595 - DNA, 183 bp, Streptococcus agalactiae
ttgtataactattgtatcactaaatgcaatacaacgcaaacaaaaaaggaaatcgtctttcccaatgaagaggctctagaatactatctagtcacactatttaatgattacaacttcaagcaagaacaacgaatccacaaaggttttggccaatgtacagacacacttgaaagcctatttgat

SEQ ID NO: 9596 - protein, 61 aa, Streptococcus agalactiae
MYNYCITKCNTTQTKKEIVFPNEEALEYYLVTLFNDYNFKQEQRIHKGFGQCTDTLESLFD

SEQ ID NO: 9597 - DNA, 309 bp, Streptococcus agalactiae
atggcaaagcgtattaaaccgaataaaaaaagagagcttttgaaagctaaagggatcaattggaaggatgttcgactatctcaaactttacaagaagtcgcattaccgaaaaagacggctcctgaagcgccaaaggcagtcgatcttttagaaggtttaactgctaataaacaagatgttttaaaagaagctggccttgtcagccttgaagcatttgcgaaagtaagtgaagcagatgttttagcactaaaaggtattggtccagcagctattaaacagttagttgataatggtgttgtttttgcaaaa

SEQ ID NO: 9598 - protein, 103 aa, Streptococcus agalactiae
MAKRIKPNKKRELLKAKGINWKDVRLSQTLQEVALPKKTAPEAPKAVDLLEGLTANKQDVLKEAGLVSLEAFAKVSEADVLALKGIGPAAIKQLVDNGVVFAK

SEQ ID NO: 9599 - DNA, 576 bp, Streptococcus agalactiae
ttgaagtatatgcagattctagaagatttcgatggcaaagcattaccaaaactagaaacggatcggcttatcttgcgtcagcgaacggtgggggatgtcccagccatgtttgattacgtttgcttggaagaggttgcctatccagcaggactcagcccaatagcttctttagaagatgagtacgattattttgaaaatcgctactatcaaaatctggaaaaggcaaaattaccatctggttatggtattaccgttaaaggaagtgatcgtattatcggatcctgcgcctttaaccatcgccatgaagacgatgttttcgagatttgctatctgcttcatcctgactactggggtcatggctatatgacagaagctgtcgccgctttgattgaagtcggttttacccttctcaatctccacaaaatcgaaatccgctgctatgattacaataagcaaagccggcgcgtggcagaaaaactaggattcacccttgaagctaccattcgtgatcgtaaggataatcaagacaatcgctgtgtcaatttgatatatggtttgctgaggagtgagtgggag

SEQ ID NO: 9600 - protein, 192 aa, Streptococcus agalactiae
MKYMQILEDFDGKALPKLETDRLILRQRTVGDVPAMFDYVCLEEVAYPAGLSPIASLEDEYDYFENRYYQNLEKAKLPSGYGITVKGSDRIIGSCAFNHRHEDDVFEICYLLHPDYWGHGYMTEAVAALIEVGFTLLNLHKIEIRCYDYNKQSRRVAEKLGFTLEATIRDRKDNQDNRCVNLIYGLLRSEWE

SEQ ID NO: 9601 - DNA, 1173 bp, Streptococcus agalactiae
atgacccagtttaccacagaattacttaacttcctagctcaaaaacaagatattgatgaatttttccgttcgtctcttgaaactgccatgaatgaccttctccaagtggagctatccgccttccttggctatgaaccatacgataaggcaggttacaacaccggtaatagtcgtaatggtgcttatacacgtcgatttgagaccaagtatggtgttgttaatttgttgatccctagagatcgaaacggggagttcagtccagccttaatcccaagttacggtcgtcgagacaatcatttagaagaaatggttatcaagctttatcgaactggagtcacaacacgtgaaatcagcgacatcattgagcgtatgtatggtcatcattacagtccagcaacagtatctaatatctcgaaagcgacacaggaaaacgtggctagctttcatgaacgttccttagaagctaactataccgtattatatcttgatgggacttaccttcctctgagacgtggtacagttagtaaggaatgcatccacattgcactaggcgtcacatcatatgggcataaggctatccttggatatgacatcgcacccaatgaaaacaatgcttcgtggtcagaccttctagaaagatttaagggtcaaggtgtacaacaagtctctcttgttgtgagtgatggttttaatggacttgatcagcttatccagcaagccttcccaatggccaaacaacagcgttgccttgtccatattggccgaaatattgcaagtaaggtgaaacgagcagatcgtgctctaattttggagcagtttaaaacaatttatcgcgcgatcaatgtagaggaagcaaagcaagccttagatagctttatcaatgagtggaaaccacactacaagaaggtaatagagaccttagaatcaatcgaaaatctattgatcttttatgaatttcctcatcagatctggggaagtatctactcgaccaaccttattgaatcacttaacaaagaaatcaaacgtcaaaccaaaaagaaagtcgtctttcccaatgaagaatccctagaacgctatctcgtcacactatttagtgattacaacttcaagcaaggacaacgaatccacaaaggttttggccaatgtacggacacacttgaaagcctatttgat

SEQ ID NO: 9602 - protein, 391 aa, Streptococcus agalactiae
MTQFTTELLNFLAQKQDIDEFFRSSLETAMNDLLQVELSAFLGYEPYDKAGYNTGNSRNGAYTRRFETKYGVVNLLIPRDRNGEFSPALIPSYGRRDNHLEEMVIKLYRTGVTTREISDIIERMYGHHYSPATVSNISKATQENVASFHERSLEANYTVLYLDGTYLPLRRGTVSKECIHIALGVTSYGHKAILGYDIAPNENNASWSDLLERFKGQGVQQVSLVVSDGFNGLDQLIQQAFPMAKQQRCLVHIGRNIASKVKRADRALILEQFKTIYRAINVEEAKQALDSFINEWKPHYKKVIETLESIENLLIFYEFPHQIWGSIYSTNLIESLNKEIKRQTKKKVVFPNEESLERYLVTLFSDYNFKQGQRIHKGFGQCTDTLESLFD

SEQ ID NO: 9603 - DNA, 537 bp, Streptococcus agalactiae
atgagagtagtagcaggaacatttggagggcgtcctttaaaaacgcttgatggaaaaacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgt

SEQ ID NO: 9604 - protein, 179 aa, Streptococcus agalactiae
MRVVAGTFGGRPLKTLDGKTTRPTTDKVKGAIFNMIGPFFEGGRVLDLFSGSGSLAIEAISRGMDQAVLVEKDRRAQVVIQENIAMTKSPEQFQLLKMEANRALEQLTGQFDLVLLDPPYAKEEIVKQIQIMDSKGLLGDDIMIACETDKSVDLPEEIASFGIWKQKIYGISKVTVYVR

SEQ ID NO: 9605 - DNA, 432 bp, Streptococcus agalactiae
atgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatt

SEQ ID NO: 9606 - protein, 144 aa, Streptococcus agalactiae
MLFYAGADVAIINSGLIVQPFEKDFSRKNLHESLPHQMRLAKLTVSSQELLEIYETIYQQGQFLAQQKIHGMGFRGKCFGEVLHSGFDYKNGKIVYNEKDIDAKEEVILVIVDQYYFASYFECLKTKKVDLLFLNYSEMWQQII

SEQ ID NO: 9607 - DNA, 1104 bp, Streptococcus agalactiae
atgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcag

SEQ ID NO: 9608 - protein, 368 aa, Streptococcus agalactiae
MPKKTDTPAYKPSIYSLTRDELIAWAIEHGEKKFRASQIWDWLYKKRVQSFDEMTNISKDFIALLNENFVVNPLKQRIVQESADGTVKYLFELPDGMLIETVLMRQHYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNDLRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGQ

SEQ ID NO: 9609 - DNA, 585 bp, Streptococcus agalactiae
gtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgac

SEQ ID NO: 9610 - protein, 195 aa, Streptococcus agalactiae
MQGKVYKMLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 9611 - DNA, 990 bp, Streptococcus agalactiae
atgtcatttcaaacaaattatatccatttggctgacgaaatattatctggaaagactagcatttcttatgaacaagcgctggaaattctaaatagcgatgagaactggtgggaaatctacgctgctgccttataccttaaaaatcaagttagccgaaataatattcgccttaacgttttattaagtgctaagcaaggactttgtgcagaaaattgtggttactgttctcaatctaaagaaagcactgctgacattgataaatttggtctgcttcctcaaaatgtcattctaaaacaggctattgtcgctcatcaaaatggtgctagcgtcttttgtattgcgatgagtggaactaagcctagcaagagagaaattgagcagttatgtcaagtcatccctgaaatcaaaaaaagcctccctctagaaatatgccttaccgctggttttttggatagagaacaacttcatcagctaaaacaagcaggaattgaccgtatcaatcataatctcaacacccccgaagaaaactaccccaacattgcaacgacgcatagcttcaaagatcgttgtgatactttagaaagaattcacaatgaagacattgatgtttgttctggattcatttgtggtatgggagagagcgatgaggggctcatcacattagctttcagactaaaagagctggacccctattctatccctgtcaattttttacttgctgttgaaggaacacctcttggaaaatataactatttgactcccattaaatgcttaaaaattatggccatgttgcgttttgtttttcctttcaaggaattaagattaagcgctggacgagaggtccattttgagaattttgaatcattagtcaccttacttgttgactcaacttttttgggaaattacctaacagagggcggtcgcaatcaacataccgatattgaattcttggaaaaattacaactaaatcatactaaaaaggaattaatt

SEQ ID NO: 9612 - protein, 330 aa, Streptococcus agalactiae
MSFQTNYIHLADEILSGKTSISYEQALEILNSDENWWEIYAAALYLKNQVSRNNIRLNVLLSAKQGLCAENCGYCSQSKESTADIDKFGLLPQNVILKQAIVAHQNGASVFCIAMSGTKPSKREIEQLCQVIPEIKKSLPLEICLTAGFLDREQLHQLKQAGIDRINHNLNTPEENYPNIATTHSFKDRCDTLERIHNEDIDVCSGFICGMGESDEGLITLAFRLKELDPYSIPVNFLLAVEGTPLGKYNYLTPIKCLKIMAMLRFVFPFKELRLSAGREVHFENFESLVTLLVDSTFLGNYLTEGGRNQHTDIEFLEKLQLNHTKKELI

SEQ ID NO: 9613 - DNA, 492 bp, Streptococcus agalactiae
atgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatgg

SEQ ID NO: 9614 - protein, 164 aa, Streptococcus agalactiae
MKKLFKKAIAMCRDLPLNFVIVELSLYQREDGSSDNIKWISKRILEVTVTDQQWIYHLRMLNLPKLKPMSLASSDCPAREEKASLISIEECQKFTSLVRDKNPFHQGEAAIVPAALLLEKIMEVRKGKIKEIHLTFLSPVRVNQEFSVQVVDNTVIIFQHQILW

SEQ ID NO: 9615 - DNA, 1353 bp, Streptococcus agalactiae
atgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagag

SEQ ID NO: 9616 - protein, 451 aa, Streptococcus agalactiae
MKTITTFENKKVLVLGLARSGEAAARLLAKLGAIVTVNDGKPFDENPTAQSLLEEGIKVVCGSHPLELLDEDFCYMIKNPGIPYNNPMVKKALEKQIPVLTEVELAYLVSESQLIGITGSNGKTTTTTMIAEVLNAGGQRGLLAGNIGFPASEVVQAANDKDTLVMELSSFQLMGVKEFRPHIAVITNLMPTHLDYHGSFEDYVAAKWNIQNQMSSSDFLVLNFNQGISKELAKTTKATIVPFSTTEKVDGAYVQDKQLFYKGENIMSVDDIGVPGSHNVENALATIAVAKLAGISNQVIRETLSNFGGVKHRLQSLGKVHGISFYNDSKSTNILATQKALSGFDNTKVILIAGGLDRGNEFDELIPDITGLKHMVVLGESASRVKRAAQKAGVTYSDALDVRDAVHKAYEVAQQGDVILLSPANASWDMYKNFEVRGDEFIDTFESLRGE

SEQ ID NO: 9617 - DNA, 603 bp, Streptococcus agalactiae
atggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacga

SEQ ID NO: 9618 - protein, 201 aa, Streptococcus agalactiae
MALKDRFDKIISYFDTDDVSENEVHEVQERTSVQRDSRAATAQEASQRSHMTNSAEEEMIGSRPRTYTYDPNRQERQRVQRDNAYQQATPRVQNKDSVRQQREQVTIALKYPRKYEDAQEIVDLLIVNECVLIDFQYMLDAQARRCLDYIDGASRVLYGSLQKVGSSMFLLTPANVMVDIEEMNIPKTGQETSFDFDMKRR

SEQ ID NO: 9619 - DNA, 690 bp, Streptococcus agalactiae
atgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggt

SEQ ID NO: 9620 - protein, 230 aa, Streptococcus agalactiae
MNFSFLPQYWSYFNYGVMVTIMISTCVVFFGTIIGVLIALVKRTNLHFLTILANFYVWVFRGTPMVVQIMIAFAWMHFNNLPTISFGVLDLDFTRLLPGIIIISLNSGAYISEIVRAGIEAVPSGQIEAAYSLGIRPKNTLRYVILPQAFKNILPALGNEFITIIKDSALLQTIGVMELWNGAQSVVTATYSPVAPLLFAAFYYLMLTTILSALLKQMEKYLGKGVKIDG

SEQ ID NO: 9621 - DNA, 1692 bp, Streptococcus agalactiae
atgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaa

SEQ ID NO: 9622 - protein, 564 aa, Streptococcus agalactiae
MNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMITASHNPQAYNGYKAYWKEGSQILDDIADQIANHMDAITDYQQIKQIPFEEALASGSASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDKFGYYNERQFSLELEGAEGQERISRIMEDFRQDPILQVGEMTLENSIDFKDGYKDFPKQNCLKYYFNEGSWYALRPSGTEPKIKCYLYTIGCTEADSLSKLNAIESACRAKMNSTK

SEQ ID NO: 9623 - DNA, 711 bp, Streptococcus agalactiae
atggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaa

SEQ ID NO: 9624 - protein, 237 aa, Streptococcus agalactiae
MAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 9625 - DNA, 1218 bp, Streptococcus agalactiae
atgtatcatgttaccgttggaatatccgaaaaagaatatgatgcctttgctattgcatcgtctcaaaccaatctcctccactcttcaaagtgggcacaagtaaaatcaaattggcaaaatgaacgtttaggcttttataaagatgaccaattagttgctgtagctagcatcttaattaaatcattaccacttggttttacaatgctttatattccacgtggacctattatggactacagcaataaagaattagttaactttgtgttaaaaacactaaaaaactttggacgaaagaaacgtgctgtttttgcaaaattcgatccagcacttcttctacgtcaatatcaccttaaagaagagaatgtcgccgaagagatagatgaaagtagacaggcaattgataatcttaagtcagcaggtgcccaatggataggtccaacgaaagccatttccgaaaccatccaacctcgttttcaagcgaatatctataccaaagcaaatatagaagaaaactttccaaaacacactaaacgtctgataaaagatgcaaagcatcgcggtgttcaaatttatcgtgccaacattgatgatttacctaaattcgccacggttgtagcattaaccgagaatcgtaaaggtgtagctttacgtaatgaaaactatttccatcaactaatgacaatttatggagaagatgcctatctctatttagctaaagtcaatcttcctaaaagattagcgcaatttaaagaacaacttcttcaaatccaaaaagatttatcagaaactccatcccatcaaaaaagtcgcctgacaaggctaaatcaacaagaagcttctgttaaacaatatatccttgaatttcaggagtttagcaagaaatatccagatgagcctgtcattgcaggaattttgtccattcgttttggcaatgtcctggagatgttgtatgctggtatggatgatagcttccgtaaattttatccacagtatctcttgaatgctagggtgttcgaagatgctttcaaaaacgatattgtatctgctaatctaggcggtgtcgagggaagtcttaacgatggtttaacaaaatttaaaagtaacttcaatccaatgtttgaagaatatattggcgagtttaatctagcaatcaatccattattatataaattggccaacctagcctatactattcgaaaaaaacaaagacactctcac

SEQ ID NO: 9626 - protein, 406 aa, Streptococcus agalactiae
MYHVTVGISEKEYDAFAIASSQTNLLHSSKWAQVKSNWQNERLGFYKDDQLVAVASILIKSLPLGFTMLYIPRGPIMDYSNKELVNFVLKTLKNFGRKKRAVFAKFDPALLLRQYHLKEENVAEEIDESRQAIDNLKSAGAQWIGPTKAISETIQPRFQANIYTKANIEENFPKHTKRLIKDAKHRGVQIYRANIDDLPKFATVVALTENRKGVALRNENYFHQLMTIYGEDAYLYLAKVNLPKRLAQFKEQLLQIQKDLSETPSHQKSRLTRLNQQEASVKQYILEFQEFSKKYPDEPVIAGILSIRFGNVLEMLYAGMDDSFRKFYPQYLLNARVFEDAFKNDIVSANLGGVEGSLNDGLTKFKSNFNPMFEEYIGEFNLAINPLLYKLANLAYTIRKKQRHSH

SEQ ID NO: 9627 - DNA, 810 bp, Streptococcus agalactiae
atgacttcaattaaacttgttgccgtagatattgacggcaccctattaaatagtaagcgtgaaattacacctgaagtggctaaagctgttcaagaagcaaaatcaaaaggcgttaaaattgttattgctacaggacgtccaatcatcggagtccaagatcttttagaagaattgaaactcaatgaagagggagattatgttatcacctttaacggcggtctagttcaagacacagccacaggagatgacatcatcaaagaaaccttaacctatgaagactatctggatttcgaactgttagcgcgtaaattaggcgtccacatgcacgccattacaaaagaaggaatttacacagcaaatcgtgatattggtaaatatacaatacacgaagtaactttagttaatatgccgctcttctatcgtactcctgaagaaatgggagacaaagaaatcattaaactaatgatgattgatcaacctgacatcttagatgcagcaattgctaaaattccaaaaaaagttctcgataactacactattgtaaaatcaactcctttttatttagaaattttacccaaaaacgttaataaaggcactgcacttctccaccttgcagagaaaatgggattaactgtagatcaaacaatggctattggtgatgaagaaaatgaccgtgctatgcttgaagttgttggaaatcctgttgttatgcaaaacggcaatcctgaactaaaaaaaatagcaaaatatatcaccaaatcaaacgaggaaagtggcgtagcctacgcactacgtgaatgggtaataaac

SEQ ID NO: 9628 - protein, 270 aa, Streptococcus agalactiae
MTSIKLVAVDIDGTLLNSKREITPEVAKAVQEAKSKGVKIVIATGRPIIGVQDLLEELKLNEEGDYVITFNGGLVQDTATGDDIIKETLTYEDYLDFELLARKLGVHMHAITKEGIYTANRDIGKYTIHEVTLVNMPLFYRTPEEMGDKEIIKLMMIDQPDILDAAIAKIPKKVLDNYTIVKSTPFYLEILPKNVNKGTALLHLAEKMGLTVDQTMAIGDEENDRAMLEVVGNPVVMQNGNPELKKIAKYITKSNEESGVAYALREWVIN

SEQ ID NO: 9629 - DNA, 927 bp, Streptococcus agalactiae
atggttatcatgattaatttctttagacatttctgggaatcgcttaaaaacttgaaacgtaacttttggatgacttttgcttctgtaacatcagttaccataaccttacttcttgtaggcttgttttcatcagttttactgaatgttgaaaagttaacaactgatgtttcaggtaattttactatcagtgcctttttaaatgttgactcaacggatgctcaaaaacaagtcaaagataaggacggaaagctaaaagataatcctgattatcataaagtttacgacaaaattaaacgtatttctggtgtagagaaagtcacttattcaagtaaagctgaacaattaaaagaagttcaaaaagagtatggttcagatgttattgatgatacctataaagatgctttgttagatgtttacgtagttgggacaagttctgcaaaagtttctaagagtgtcagtgaagcaattggacgcattgaaggtgttgattatactaaagaacctattgattcaacaaaactatctaatctcacagataacatccgtatatggggatttggtggtgttgccttattaattgtccttgctatctttttgatttcaaatactattcgtatgtcgattatgtcacgccgtacagatattgaaatcatgagattagttggcgctaaaaattcttatattcgaggaccgttcttttttgaaggtgcttgggtagggattttaggggctatcgttccatcgctgattttctattttggttatcaatttgtgtttaacaagtttaatccaaaatttgagacaagccatgtttcattgtatcctatggatattatggttccagcaattattggtggtatggtgattattggtattattattggctcacttgggtctgtcctatcaatgagacgttaccttaagatt

SEQ ID NO: 9630 - protein, 309 aa, Streptococcus agalactiae
MVIMINFFRHFWESLKNLKRNFWMTFASVTSVTITLLLVGLFSSVLLNVEKLTTDVSGNFTISAFLNVDSTDAQKQVKDKDGKLKDNPDYHKVYDKIKRISGVEKVTYSSKAEQLKEVQKEYGSDVIDDTYKDALLDVYVVGTSSAKVSKSVSEAIGRIEGVDYTKEPIDSTKLSNLTDNIRIWGFGGVALLIVLAIFLISNTIRMSIMSRRTDIEIMRLVGAKNSYIRGPFFFEGAWVGILGAIVPSLIFYFGYQFVFNKFNPKFETSHVSLYPMDIMVPAIIGGMVIIGIIIGSLGSVLSMRRYLKI

SEQ ID NO: 9631 - DNA, 762 bp, Streptococcus agalactiae
atgtcaaaagttgctattgttactggtgctggtcaaggaattggatttgctattgcgaaacgtcttcatgcagacggctttaaaataggcgttttagactataatgaagagactgctcaggctgcggttgataaactatcacctgaggatgctgttgcagttgtagcagatgtttcaaaacgtgatcaagtttttgatgctttccaaaaagttgtagatacttttggtgatttgaatgttgttgttaacaatgcaggtgttgccccaacaactcctcttgacactattactgaagagcagtttgaaaaggcttttgcaatcaatgtcggaggaactatttggggaagccaagcagctcagaaacattttagagaattaggtcatggcggaaaaattataaatgcaacttcacaagcaggatgtgaagggaatcctaatttgactgtttatggtggtacaaaatttgcagttcgtggtattacacagactttggcaaaagatttagcatcagaaggaatcacagtcaatgcttacgcaccaggtattgttaaaacacctatgatgtttgatattgcccatgaagttggtaagaatgcaggcaaagatgatgaatggggtatggagcagtttgccaaagatatcactttgaaacgcttgtctgaaccagaagatgttgctaatgcagtaggcttcttagcgggagatgattcaaattatatcactggacaaacaatagttgtcgatgggggtatggtattccat

SEQ ID NO: 9632 - protein, 254 aa, Streptococcus agalactiae
MSKVAIVTGAGQGIGFAIAKRLHADGFKIGVLDYNEETAQAAVDKLSPEDAVAVVADVSKRDQVFDAFQKVVDTFGDLNVVVNNAGVAPTTPLDTITEEQFEKAFAINVGGTIWGSQAAQKHFRELGHGGKIINATSQAGCEGNPNLTVYGGTKFAVRGITQTLAKDLASEGITVNAYAPGIVKTPMMFDIAHEVGKNAGKDDEWGMEQFAKDITLKRLSEPEDVANAVGFLAGDDSNYITGQTIVVDGGMVFH

SEQ ID NO: 9633 - DNA, 1191 bp, Streptococcus agalactiae
atgacctatttgtcagaacgtgtactcaatatggaagagagtgttactttagctgcgggagctaaagcaagagaactcagagtacaaggaagagatattcttagtttaactttaggggagcctgactttgctactcctaaaaacattcagcaagcggctattgaggctataacagatggacgtgcaagtttttacacaccatcaagtggtttgccggagttgaagtcagcaattaatgcgtattttgaacgtttttatggctactcccttaaacctaatcaggtggttgtgggaactggtgctaagtttatcctttatactttctttatgacagtactgaatcccggtgatgaagtaattattccgactccttattgggtatcttatgctgatcagattaagatggctgaaggtaagccagtttttgtcacagcaaaagaagttaatcacttcaaagtaactgtggaacagttagaagctgttaggactgataagacaaaagtcatacttcttaatagtccatcaaatcctacaggtatgatttataaagctgaggagttggaggctattggaaattgggcagtcgaacatgatatcctaattttagcagatgatatttacggtcgattggtttacaatggcaatatttttacccctatttcaagcctttcagagtctattcgaaaccaaacgatagtcataaatggagtttctaagacttatgcgatgacaggttggcgtgttggttttgcagtgggtaatcatgatattatagcggcaatgtctaaagtagtcagtcaaacaacttctaaccttacggctgtctcacagtatgctactattgaggctttaaatggttctcaagagtcatttgaaaaaatgaggctagcatttgaagaacgccttaatatcatttatccattgttgtgtcaggtccctgggtttgaggttgttaaaccacaaggtgctttttatcttttcccaaatgttacaaaagcaatggaaatgaaaggatatacggatgttacagcattcacggatgccattcttgaagaagttggacttgctttagtaacgggtgctggttttggagcgccggaaaatgttcgtctgagttatgctacagatcttgaaacccttaaagaagctgttcgtagactgcatgtctttatgggaagtaatgaaattaat

SEQ ID NO: 9634 - protein, 397 aa, Streptococcus agalactiae
MTYLSERVLNMEESVTLAAGAKARELRVQGRDILSLTLGEPDFATPKNIQQAAIEAITDGRASFYTPSSGLPELKSAINAYFERFYGYSLKPNQVVVGTGAKFILYTFFMTVLNPGDEVIIPTPYWVSYADQIKMAEGKPVFVTAKEVNHFKVTVEQLEAVRTDKTKVILLNSPSNPTGMIYKAEELEAIGNWAVEHDILILADDIYGRLVYNGNIFTPISSLSESIRNQTIVINGVSKTYAMTGWRVGFAVGNHDIIAAMSKVVSQTTSNLTAVSQYATIEALNGSQESFEKMRLAFEERLNIIYPLLCQVPGFEVVKPQGAFYLFPNVTKAMEMKGYTDVTAFTDAILEEVGLALVTGAGFGAPENVRLSYATDLETLKEAVRRLHVFMGSNEIN

SEQ ID NO: 9635 - DNA, 711 bp, Streptococcus agalactiae
atggtagttgacatgcgtagtcgtcttttctttagagaaattaactctattttggatagccttgaaattaatgataatattaactttaagattctatttttagatgctactgacaccgagctagtgtcacgatataaagagacacgtcgtagccaccctcttgctgccgacggcagagtgttagatggtatttctctagagagagaactattagcaccgcttaaaagtatgagtcagaacgttgtggacactagtgaattaacaccaagacaactacgtaaggtcatttctaaagaattctcaaatcaagatagtcaaagttcttttcgtatcgaagttatgagttttggttttaaatatggtatacctttggatgcggatttagtattcgatgtgcgttttttaccaaatccatactataaaccagaattaagagataagacaggtttagatactgaggtttatgactatgtcatgagttttgatgaatcagatgatttttatgaccatcttcttgccttaataaagccaatcttaccaggctatcaaaatgaagggaaatctgttttgactgtggcaatcggatgtacaggtgggcaacatcgtagcaccgcttttgctcatagattatcagaagatttaaaagcagattggacagttaatgaaagccatcgtgataaaaataagcgtaaggagacggtaaatcgttca

SEQ ID NO: 9636 - protein, 237 aa, Streptococcus agalactiae
MVVDMRSRLFFREINSILDSLEINDNINFKILFLDATDTELVSRYKETRRSHPLAADGRVLDGISLERELLAPLKSMSQNVVDTSELTPRQLRKVISKEFSNQDSQSSFRIEVMSFGFKYGIPLDADLVFDVRFLPNPYYKPELRDKTGLDTEVYDYVMSFDESDDFYDHLLALIKPILPGYQNEGKSVLTVAIGCTGGQHRSTAFAHRLSEDLKADWTVNESHRDKNKRKETVNRS

SEQ ID NO: 9637 - DNA, 258 bp, Streptococcus agalactiae
atgaaaaaagacatccatccagattatcgtccagttgttttcttagatacaactacaggttacaaattccttagtggttcaactaaatcaactaaagaaacagtagaattcgaaggtgaaacttacccacttattcgtgtggaaatctcatcagattcacatccattctatacaggacgtcaaaaattcactcaagcagatggacgtgtggaccgtttcaacaaaaaatatggtctcaaagacgcaaacgctgctcaa

SEQ ID NO: 9638 - protein, 86 aa, Streptococcus agalactiae
MKKDIHPDYRPVVFLDTTTGYKFLSGSTKSTKETVEFEGETYPLIRVEISSDSHPFYTGRQKFTQADGRVDRFNKKYGLKDANAAQ

SEQ ID NO: 9639 - DNA, 441 bp, Streptococcus agalactiae
atggctttagcaaagattgtttatgctagcatgaccggaaatactgaagaaattgctgacattgttgctgataaattacgtgacttgggtctagatgttgaagtagaagagtgtacgatggttgatgctgcagattttgaagatgctgacattgcaattgttgccacttatacatatggtgatggagatttaccagatgaaatcgtggacttttatgaagatttagcagaggttgatttatctggtaaagtttacggcgtagtgggttcaggtgatactttctatgattacttctgcaaatctgttgatgagttcgaggctcaattcgcattaacaggagcacaaaaaggtgctgattgtgttaaagttgatttagcggcagaagacgaagacattgaaaacttagaagcttttgctgaagaaattgcttctaaacttaac

SEQ ID NO: 9640 - protein, 147 aa, Streptococcus agalactiae
MALAKIVYASMTGNTEEIADIVADKLRDLGLDVEVEECTMVDAADFEDADIAIVATYTYGDGDLPDEIVDFYEDLAEVDLSGKVYGVVGSGDTFYDYFCKSVDEFEAQFALTGAQKGADCVKVDLAAEDEDIENLEAFAEEIASKLN

SEQ ID NO: 9641 - DNA, 345 bp, Streptococcus agalactiae
atgaatccattaattcaaagtttgacagaaggtcaacttcgttctgatatccctgagttccgtgctggtgatactgtacgtgttcacgctaaagttgtcgaaggtactcgcgaacgtattcagatctttgaaggtgttgttatctcacgtaaaggtcaaggaatctcagaaatgtacacagtacgtaaaatttctggtggtatcggtgtagagcgtacattcccaattcacactcctcgtgttgataaaatcgaagttgttcgttatggtaaagtacgtcgtgctaaactttactacttacgcgcattgcaaggtaaagctgcacgtattaaagaaatccgtcgt

SEQ ID NO: 9642 - protein, 115 aa, Streptococcus agalactiae
MNPLIQSLTEGQLRSDIPEFRAGDTVRVHAKVVEGTRERIQIFEGVVISRKGQGISEMYTVRKISGGIGVERTFPIHTPRVDKIEVVRYGKVRRAKLYYLRALQGKAARIKEIRR

SEQ ID NO: 9643 - DNA, 795 bp, Streptococcus agalactiae
atgcatctaggaaaatatataaaaaagtatcgagataccaataatctgagcatggctgaattcgctaaagaatcaggcatcagcaaagcttacgtttctattcttgaaaaaaacagagatcctcgtaacggaaaagaaatcatcccatctattccgattataaagaaagtttctgacacaattggcatctcttttgatgatttattaaattcgctagacgaaaatcagatagtcgcgttaaatgaaacgaaaactgaaaaaaatctaacttcctctaccctacaaaaaatcacttctacttcttctcaattagaacaacctagacaagaaaaagtccttagcttcgctaacgaacaattagaagaacaaaataaagttgtttctatgttcgatagaaaagttgaggagacagaaaattatatcactgactacgttgaggggttagttgctgctggtctgggggcataccaagaagacaatttacatatggaagttaaactacgggctgatgatgtccccgataagtatgatactattgcgaaagtagctggtaattcaatggaaccacttattcaagataacgatttactgttcgtcaaggtatctagtcaagtcgatatgaatgatatagggatattccaagtcaatggaaaaaactttgtaaaaaaactcaaacgtgattatgacggcgcttggtacttgcaaagtttaaataaaagctatgaggaaatctatctttcagagaacgacaacatccgcacgataggagaagtcgtagatatttacagggagaat

SEQ ID NO: 9644 - protein, 265 aa, Streptococcus agalactiae
MHLGKYIKKYRDTNNLSMAEFAKESGISKAYVSILEKNRDPRNGKEIIPSIPIIKKVSDTIGISFDDLLNSLDENQIVALNETKTEKNLTSSTLQKITSTSSQLEQPRQEKVLSFANEQLEEQNKVVSMFDRKVEETENYITDYVEGLVAAGLGAYQEDNLHMEVKLRADDVPDKYDTIAKVAGNSMEPLIQDNDLLFVKVSSQVDMNDIGIFQVNGKNFVKKLKRDYDGAWYLQSLNKSYEEIYLSENDNIRTIGEVVDIYREN

SEQ ID NO: 9645 - DNA, 747 bp, Streptococcus agalactiae
atgaatcaactaataaacatcaccctaaacgaaaatcaagaaccagttgtcagtggtagagatttacacaatgtacttaatataaaaactcaatatactaaatggcttgaaaggatgtcggaatatggttttgaagaaaacgttgactatatagctattagtcaaaaaagactaacagctcaaggtaaccgtacagaatatatagaccacgttctcaagctagacatggcaaaagagattgctatgttacagcgaaacgagaaatcaaaacaggtacgcaaatacttcatccaggttgaaaaagacttcaatagtcctgagaaaatcatggcgagagccttgctcatggcagataagaaaatcactaacttaacgatggaaaataatcaattgcagttagatttaaaagaagctcaaaagcaagcgcgttatcttgatctaatcattgagagcaagggagctttgcgagtaacacagattgctgctgattatggtatgtctgtcaataaattcaataaaacactattagaatttggtgtgcagcacaaagtgaatggacaatggattctctataaacgacatatgggcaaaggttacacagacagtcacacatttgactatcaagacaaaaacggccatacaagagccaatgtgacgacgacgtggacacaaaaggggcgtctattcctgtacgagttgttgaaagacaacaatattttgccactaattgaacaggaagacattgta

SEQ ID NO: 9646 - protein, 249 aa, Streptococcus agalactiae
MNQLINITLNENQEPVVSGRDLHNVLNIKTQYTKWLERMSEYGFEENVDYIAISQKRLTAQGNRTEYIDHVLKLDMAKEIAMLQRNEKSKQVRKYFIQVEKDFNSPEKIMARALLMADKKITNLTMENNQLQLDLKEAQKQARYLDLIIESKGALRVTQIAADYGMSVNKFNKTLLEFGVQHKVNGQWILYKRHMGKGYTDSHTFDYQDKNGHTRANVTTTWTQKGRLFLYELLKDNNILPLIEQEDIV

SEQ ID NO: 9647 - DNA, 222 bp, Streptococcus agalactiae
atggaaaatccaatgacaggagtagcaatactagcatttatcgctttacttgcatatctcggcaatcgtaatagcaatcaaaagacaattactaagactgttgagacggtgttagataactaccaagttgtgcgaaaggttgagagaccaaaacgcacggattttatagagttacctaccccaggatcatgcgggaaagtttggggcaaggatagacctttt

SEQ ID NO: 9648 - protein, 74 aa, Streptococcus agalactiae
MENPMTGVAILAFIALLAYLGNRNSNQKTITKTVETVLDNYQVVRKVERPKRTDFIELPTPGSCGKVWGKDRPF

SEQ ID NO: 9649 - DNA, 252 bp, Streptococcus agalactiae
atggttgaaatcagaattaacggtgagtcaatcacatttgatagcaattttagggatgcgcttatatttacggtagatcacctaaaaaattatgacgatccttctttgaggcagacttacaacgagtttaaagattatacagacgaggacttgatgggatatatcagcacagaatttgatgtagacccggaaatgtttgttgatactaattcagacagcagatggaaaattaaacaacgaattttagaggac

SEQ ID NO: 9650 - protein, 84 aa, Streptococcus agalactiae
MVEIRINGESITFDSNFRDALIFTVDHLKNYDDPSLRQTYNEFKDYTDEDLMGYISTEFDVDPEMFVDTNSDSRWKIKQRILED

SEQ ID NO: 9651 - DNA, 384 bp, Streptococcus agalactiae
atgaccaaggatgccgaacttcgttatacaccaagtaatcaagcggtagctactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtatctatgtaacagaagttgttgcggaaaatttccaattattagaaagtcgcaatagccaacaacagactaatcaaagcggcaatagttctaattcttattttggcaatgccaacaaaatggatatttcagatgatgacttaccattc

SEQ ID NO: 9652 - protein, 128 aa, Streptococcus agalactiae
MTKDAELRYTPSNQAVATFSLAVNRNFKNQSGEREADFINCVIWRQQAENLANWAKKGALVGITGRIQTRNYENQQGQRIYVTEVVAENFQLLESRNSQQQTNQSGNSSNSYFGNANKMDISDDDLPF

SEQ ID NO: 9653 - DNA, 474 bp, Streptococcus agalactiae
atgacttttaagacagaatttgaaataccaatcgaaccaaaacctcaaactagacctaagttcagcaaatttggtacgtacgaagatccaaagatgaagagatggcgaaaagaggtttctggatggatagaaaaaaattatgatggaccgtttttcgatgattgcataaaggtagaggtaaccttttacatgaaagcccccaaaacgctatcaaaagagcctacacaacgttctaaaggtaaaacaatacaaatatatcagaacttcgtgcgtgagcttatatggcacgctaagaagcctgatattgataatctgattaaagctgtttttgatagtatttccgatgcaggttacgacagaatacagaaatcaggtatcgtttggtcagatgacaatatcgtatgcgatttaagagcaaagaaaaaatacagtcagaatccaagaataaaagtgaggattgaagagattgacaga

SEQ ID NO: 9654 - protein, 158 aa, Streptococcus agalactiae
MTFKTEFEIPIEPKPQTRPKFSKFGTYEDPKMKRWRKEVSGWIEKNYDGPFFDDCIKVEVTFYMKAPKTLSKEPTQRSKGKTIQIYQNFVRELIWHAKKPDIDNLIKAVFDSISDAGYDRIQKSGIVWSDDNIVCDLRAKKKYSQNPRIKVRIEEIDR

SEQ ID NO: 9655 - DNA, 345 bp, Streptococcus agalactiae
ttgacagatgaattaataaatcaattttacaaaatttttgacaatgggattgtaaggcaaattaaaaagctagatgtagattgtaaaaaagccgagcaaataagatgtagcgttacaaataacagacgtcgaaaaaccctgccaagaccgtacgttatcgaagcgtttaaagattattttgacgaagatacctatgcacagatgtatatcaaatcatatcgtgagtatcacaacccaaatgaccacgagacggaactttttgtaaaactaaaaagagcgcacaaagatactaagttagagcattacaaggaagttaagcgattgatgtacgcagcaatgaccttt

SEQ ID NO: 9656 - protein, 115 aa, Streptococcus agalactiae
MTDELINQFYKIFDNGIVRQIKKLDVDCKKAEQIRCSVTNNRRRKTLPRPYVIEAFKDYFDEDTYAQMYIKSYREYHNPNDHETELFVKLKRAHKDTKLEHYKEVKRLMYAAMTF

SEQ ID NO: 9657 - DNA, 267 bp, Streptococcus agalactiae
atgactgaacaacagatgattgattgcttgctttatgagttagcaaaaaaagacaaattgaacattagacgaaacaatatcataacgtttttatcgattgtgctgatggctatatctattttaaacgtcgcactgcaagaccactacaagtcgcaaattacagaattacggacacagttaagcaggacacaaaagcagcttaaacgtgctagtgatgatagagctagacagacaaaacggattgctgagctgactggaaatggggga

SEQ ID NO: 9658 - protein, 89 aa, Streptococcus agalactiae
MTEQQMIDCLLYELAKKDKLNIRRNNIITFLSIVLMAISILNVALQDHYKSQITELRTQLSRTQKQLKRASDDRARQTKRIAELTGNGG

SEQ ID NO: 9659 - DNA, 462 bp, Streptococcus agalactiae
atgtcagaatttaaagttattgaaacacaagaagagttggacacgattgtgaaagctcgcattgctcgagaacgtgagaagtatcaagattacgaccaactgaaaactcgtgttgaagaactagaaaccgaaaacagcagcttacaaactgctttgaatgatgctaaatcaaacactgatagctatacagagaaaattaccactttggaaaatcaaatcgctggttatgaggcagcaaatttacggacaaaggtagcgttacagtatggcttaccaatcgatttagctaatcgtttgcaaggcgatgatgaagacgggctcaaggtggatgcagaacgcttagcatcttttatcaagccgtctcaaccacaaccgccaacaaagtcaaatgaaccgattattaccgaccaaaaagaagcaggttggattgaaatggcacgtaatttagttaacaaaggagaa

SEQ ID NO: 9660 - protein, 154 aa, Streptococcus agalactiae
MSEFKVIETQEELDTIVKARIAREREKYQDYDQLKTRVEELETENSSLQTALNDAKSNTDSYTEKITTLENQIAGYEAANLRTKVALQYGLPIDLANRLQGDDEDGLKVDAERLASFIKPSQPQPPTKSNEPIITDQKEAGWIEMARNLVNKGE

SEQ ID NO: 9661 - DNA, 327 bp, Streptococcus agalactiae
atgtttacaattaacacaaaattcccacaagttcttgaggataaaagtattatgggagtgactgcaattgtgtcagttgatttaccacacgtgaaaggtaacttaacttttgatttaccacctgagtctgaaaataaatcttttgcagaaacgcttgaaaagtgtgagcagatattttacgacgaaaagtataaagataaagctcagtctgaaaaaatgactgaactaagtacatcaacatcaacaggcacacaaacacttatcaatctgataagtacgctttacgcaaaagaggttttaaaagatgaagatcttattgctattggt

SEQ ID NO: 9662 - protein, 109 aa, Streptococcus agalactiae
MFTINTKFPQVLEDKSIMGVTAIVSVDLPHVKGNLTFDLPPESENKSFAETLEKCEQIFYDEKYKDKAQSEKMTELSTSTSTGTQTLINLISTLYAKEVLKDEDLIAIG

SEQ ID NO: 9663 - DNA, 969 bp, Streptococcus agalactiae
atgaaacaacctttagctttgacatgggaagatcaaattagactacttgaaaaacgtggattaattgttaaagctgatgatgtagagaaaatcaaacatatcagttattatagaattaaagaatttgcaaaaccacttgaaataaagcaacaagatggtgaggagcaggatattttatatgataatattgagtttgcagaagttttggcaagatattatcaggataaaaacttaagaatctatctactgcacgctattgaaaaaattgaagtgtctattaaaacaaaaatttcttttgttttgggggatagatatggggcgttcggatatttaaatttctcttcatgggctaataggaataagtttacaaaatatgatattgaaaaaagacaatttaggattaaaaagaatttattgaatactgtaagaaaatctcaactaactgagttacaaaaatcaattaaccttgatctagatggattcccaacagtgtggcttgctattgatttattgatgtttggtgacatcgtttcaatcttaacaatcatgagtgagaagaacattaaacagatttgtcaatattacagttgtacaccagaagaacttgtttcgtggcttaaatgtttgaatttcataagaaatgtatgtgctcataattcaaatgtactggatattcaaatcacaacaaagcctaaacttcgttcagaatggagaaattatattgatacagtaataattaaacataacgtgactaaaccttctaataagttatccgttattattgctattgtagtctatcttgtaaatactattaattccaaatatcaatggagaaatatacagtctagtttgaaggctctttgtaaagaagatgacagtagggcaaagcttttaggttttaaagattatgattctgttaaagcaatgattaatgggataaagtgtactacttttacaaattcaaaaaaa

SEQ ID NO: 9664 - protein, 323 aa, Streptococcus agalactiae
MKQPLALTWEDQIRLLEKRGLIVKADDVEKIKHISYYRIKEFAKPLEIKQQDGEEQDILYDNIEFAEVLARYYQDKNLRIYLLHAIEKIEVSIKTKISFVLGDRYGAFGYLNFSSWANRNKFTKYDIEKRQFRIKKNLLNTVRKSQLTELQKSINLDLDGFPTVWLAIDLLMFGDIVSILTIMSEKNIKQICQYYSCTPEELVSWLKCLNFIRNVCAHNSNVLDIQITTKPKLRSEWRNYIDTVIIKHNVTKPSNKLSVIIAIVVYLVNTINSKYQWRNIQSSLKALCKEDDSRAKLLGFKDYDSVKAMINGIKCTTFTNSKK

SEQ ID NO: 9665 - DNA, 651 bp, Streptococcus agalactiae
atgaaaatattaactgttgaagatgataagttgataagagagggaataagtgaatacctttcagaatttggatatactgttattcaggctaaagatggaagggaagccttgtcaaaatttaatagtgatataaacttggttatcttagacattcagataccttttataaatggtttagaagtgttgaaagaaattagaaagaaaagcaatttaccaattctaattttgactgcatttagtgatgaagaatataaaattgatgcatttactaatttagtagatggatatgtagaaaaaccattttcattgcctgttttaaaggctagaatagattctttaattaagaagaattttggacatttagagaagtttgaatataagaatctttcggtaaattttaatagttatacagctaaaataaatgatgaaaaaatagatgtaaatgcaaaagaactcgaaatactaaaatgtttattggataatgatggacaagttttaacaagaatgcaaattattgattatgtctggaaggatagcgaagagatcccttatgatcgagtagtagatgtatatataaaagaacttagaaaaaaattacaattagactgtataactactataagaaatgtaggatataaattggagagaaaa

SEQ ID NO: 9666 - protein, 217 aa, Streptococcus agalactiae
MKILTVEDDKLIREGISEYLSEFGYTVIQAKDGREALSKFNSDINLVILDIQIPFINGLEVLKEIRKKSNLPILILTAFSDEEYKIDAFTNLVDGYVEKPFSLPVLKARIDSLIKKNFGHLEKFEYKNLSVNFNSYTAKINDEKIDVNAKELEILKCLLDNDGQVLTRMQIIDYVWKDSEEIPYDRVVDVYIKELRKKLQLDCITTIRNVGYKLERK

SEQ ID NO: 9667 - DNA, 585 bp, Streptococcus agalactiae
atggctaccgttaagacaaaaacagctcttaaaaagactcaaaaaacgtatcctcaaaacttactcaaccagaaatttaatcctgataaacctaatcaagtatggtctactgacttcacctatatttctattggatataagaaatatgtctatctctgcgcaataattgatctctattctagaaaatatattgcttggaaattgagtcatcgtatggatgcaaagttagcatgtgacactctagaattagctcttaataaaagaaagattgaaggaacacttctctttcattccgaccaagggtcacaatttaaggccagggaatttagaaaaataattgatgacaacaatatcatgcattctttttctaaacctagatatccttatgataatgccgtaactgaagcatttttcaagtatttaaagcatagacaaatcaaccaaaaaaattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 9668 - protein, 195 aa, Streptococcus agalactiae
MATVKTKTALKKTQKTYPQNLLNQKFNPDKPNQVWSTDFTYISIGYKKYVYLCAIIDLYSRKYIAWKLSHRMDAKLACDTLELALNKRKIEGTLLFHSDQGSQFKAREFRKIIDDNNIMHSFSKPRYPYDNAVTEAFFKYLKHRQINQKNYQNIKQVQLDCFEYIENFYNNYIPHTANLGLTPNQKEENYFNAIK

SEQ ID NO: 9669 - DNA, 1203 bp, Streptococcus agalactiae
atgtcacaaaaatcaaactattttaaagggcaaattgattatgctgttgtgataccagtattttttttattaatgattggtttagcctcaatttatgttgcaacgatgaatgattatccttctaatatctatatcgcgatgtttcagcaggtgtcttggattattatggggtgtattattgcatttgtcgttatgcttttcagtactgaatttttatggaaagccacgccctatctgtatgctttaggactaaccctaatggttcttcccttaattttttatagtccacagctttttgcggcaacaggtgctaaaaattgggtgaccattggctcggtaactttgtttcaaccgtcagagtttatgaagatttcctatattttaatgttatctcgaataactgttagttttcatcagaaaaatcgcaaaacttttcaagatgattggaagttgctaggattgtttggtttggttacattgccagtgatgattcttctaatgttacaaaaagatttaggaacagcattagttttccttgccattttgtcaggtttaatccttttatcgggcatatcttggtggataatcttgccaattttatctactatcgttctttttatagctagctttttgatgatttttatctcaccaaacggcaaggaatggttttataatttggggatggatacatatcaaatcaaccgtttatctgcttggattgatccatttagttttgcagactcaattgcttatcaacaaacacagggtatggtatcaattggaagtggcggggtaacaggtaaaggttttaatattttagagctctcggttcctgttcgtgaaagtgacatgatttttactgtcattgctgagaattttggcttcattggttcggcgattgttttagggttatatctcattatcatttaccgtatgttaaggatcaccattgaatctaataatcaattttatacttttatatcaactggttttatcatgatgattgttttccatgtttttgaaaatattggtgcagcagttggtatattacctctaacaggaatcccacttccgtttatttcgcaaggtggaagttcattactaagtaatcttattggaattggattggtcttatccatgtcttatcaaaatacagttcgtcaggccaaggctaatggatcacatttgaagtatcgtagtata

SEQ ID NO: 9670 - protein, 401 aa, Streptococcus agalactiae
MSQKSNYFKGQIDYAVVIPVFFLLMIGLASIYVATMNDYPSNIYIAMFQQVSWIIMGCIIAFVVMLFSTEFLWKATPYLYALGLTLMVLPLIFYSPQLFAATGAKNWVTIGSVTLFQPSEFMKISYILMLSRITVSFHQKNRKTFQDDWKLLGLFGLVTLPVMILLMLQKDLGTALVFLAILSGLILLSGISWWIILPILSTIVLFIASFLMIFISPNGKEWFYNLGMDTYQINRLSAWIDPFSFADSIAYQQTQGMVSIGSGGVTGKGFNILELSVPVRESDMIFTVIAENFGFIGSAIVLGLYLIIIYRMLRITIESNNQFYTFISTGFIMMIVFHVFENIGAAVGILPLTGIPLPFISQGGSSLLSNLIGIGLVLSMSYQNTVRQAKANGSHLKYRSI

SEQ ID NO: 9671 - DNA, 1860 bp, Streptococcus agalactiae
atgcgtccaggcatgtatatcggttcgacttcgaaagaagggcttcatcaccttgtatgggaaattgttgataactcaattgatgaagccttagctggatttgcaggacatattaaagtttacattgaaccagataactctattacagttgttgatgatggtcgcggtattccggtagatatccaagaaaaaactggaagaccagctgtagagacagtttttacagttctccatgccggtggtaaatttggtggtggcggatacaaggtttctggtggcttacatggtgtagggtcatctgttgttaatgcattgtcaacacaattagatgtcaaggtttataaaaatggcaaggttcattatcaagaataccaacgcggtgttgttgttaatgatcttgaaattatcggtgatactgacttatcaggaacaacagttcactttacgcctgacccagaaattttcactgaaaccactgtatttgattttgataaattagccaaacgtattcaggaattagcttttttaaatcgtggactaagaatctccatttcagacaagcgagaaggtcaagaagttgaaaaagaatatcactatgaaggtggtataggttcatacgttgagtttatcaatgagaacaaagaagtgatttttgaaaatcctatttatactgacggtgaattagatggtatttcagttgaagtagcaatgcagtatactactggatatcaagagactgttatgagttttgcaaataacatccacactcatgaaggaggaacgcacgaacaaggatttcgtactgccttgacacgtgtgattaatgattacgctaaaaagaataagattctcaaagaaaatgaagataatttaactggagaagatgttcgtgaaggtttaacagcagttatatctgttaaacatccaaatccacaatttgaaggacaaactaaaacaaaacttggaaattctgaagttgttaaaattacaaatcgtctctttagcgaagctttcaatcgattcctattagaaaatccacaagtagctaagaagattgttgaaaaaggaattttggcatctaaagcccgtattgcagcaaaacgggcgcgtgaagtaacacgtaaaaagtcaggcttagagatttcaaacttacctgggaaactggctgattgctcatctaataatgctgagatgaatgaactttttatagtggagggagattctgcgggagggtctgcaaaatcaggacgtaatcgtgagtttcaagcaattttaccgattaggggtaagattctaaacgttgaaaaagctacaatggataaaattttagcaaacgaagaaatccgaagtctcttcacagctatgggaactggatttggtgcagattttgatgtatcaaaagtcagatatcaaaaattagtcattatgactgatgccgatgttgatggagctcacatcagaactttacttttaactctgatttatcgttttatgcgacctgttttggaagcaggatatgtttatatcgctcaaccaccaatctatggtgtcaaagtaggaagtgagattaaagcttatattcagccaggggtcaatcaagaagaggaattacgtcaagctctagatacctatagttcaggacgttcaaaacctactgtacaacgttacaaaggtctaggtgagatggatgaccatcaactttgggaaacaacaatggatcctgaaaaccgcttgatggcacgtgtctcagttgatgatgcagcagaagcagataagattttcgatatgctaatgggagatcgagtagaaccacgacgtgaattcattgaagctaatgctgtttatagtaacttagatatc

SEQ ID NO: 9672 - protein, 620 aa, Streptococcus agalactiae
MRPGMYIGSTSKEGLHHLVWEIVDNSIDEALAGFAGHIKVYIEPDNSITVVDDGRGIPVDIQEKTGRPAVETVFTVLHAGGKFGGGGYKVSGGLHGVGSSVVNALSTQLDVKVYKNGKVHYQEYQRGVVVNDLEIIGDTDLSGTTVHFTPDPEIFTETTVFDFDKLAKRIQELAFLNRGLRISISDKREGQEVEKEYHYEGGIGSYVEFINENKEVIFENPIYTDGELDGISVEVAMQYTTGYQETVMSFANNIHTHEGGTHEQGFRTALTRVINDYAKKNKILKENEDNLTGEDVREGLTAVISVKHPNPQFEGQTKTKLGNSEVVKITNRLFSEAFNRFLLENPQVAKKIVEKGILASKARIAAKRAREVTRKKSGLEISNLPGKLADCSSNNAEMNELFIVEGDSAGGSAKSGRNREFQAILPIRGKILNVEKATMDKILANEEIRSLFTAMGTGFGADFDVSKVRYQKLVIMTDADVDGAHIRTLLLTLIYRFMRPVLEAGYVYIAQPPIYGVKVGSEIKAYIQPGVNQEEELRQALDTYSSGRSKPTVQRYKGLGEMDDHQLWETTMDPENRLMARVSVDDAAEADKIFDMLMGDRVEPRREFIEANAVYSNLDI

SEQ ID NO: 9673 - DNA, 1281 bp, Streptococcus agalactiae
atgaaattactgactaatgcaaatactctcaagggaaccatccgtgttcctggcgataaatcaataagtcacagggctattatttttgggagtatatctcagggagttacccgaattgttgatgtcttaagaggcgaggatgttttatcaactatagaggcttttaaacaaatgggggttctaattgaagacgatggcgagataatcactatctatggcaaaggatttgcaggtttaacacaaccgaataatctcttagacatgggaaactctggtacttcaatgcgtctgatagcaggtgtgttagctggtcaagagtttgaagtgacgatggttggagacaatagtttgtcaaagagacctatggatcgtatagcattgcctttaagcaaaatgggagctagaatttcgggagtaactaaccgtgatttaccaccattaaaacttcaaggtacaaaaaaattaaaacctattttttaccatttacccgtagcttctgcacaagtaaaatcagctttaatttttgcggctttacaaactaagggagaatctctcattgtagaaaaagagcaaacaaggaatcatactgaggacatgattcggcaatttggtggacatttggatattaaagataaagaaattcgactcaatggcggtcagagcttagtaggacaagatataagagttcctggtgatatttcgagtgctgccttttggatagtagcgggtcttattattcctaacagtcatattattttagaaaacgtaggtataaacgagacacgaactggaatccttgatgtcgtcagtaaaatgggtggaaaaattaagttatcttcggttgataatcaagtaaaatcagcaacccttacagttgattactctcatctacaagctactcatatttctggggctatgattccacgtctgattgatgaattacctattattgctcttttagcaacacaagctcaaggcaccacagtcatagcagatgctcaggaattaaaggtgaaagagacagatcggattcaggtcgttgtcgaatcgctaaaacagatgggtgctgatattactgctacagcagatggtatgattatacgtggtaatacccctcttcacgctgcttcacttgattgtcatggagatcatagaataggaatgatgatagctattgctgctctcttggtcaaagaaggcgaagtagatttatctggtgaagaagctattaatacaagctatcctaactttttagaacatttggagggattagttaatgcc

SEQ ID NO: 9674 - protein, 427 aa, Streptococcus agalactiae
MKLLTNANTLKGTIRVPGDKSISHRAIIFGSISQGVTRIVDVLRGEDVLSTIEAFKQMGVLIEDDGEIITIYGKGFAGLTQPNNLLDMGNSGTSMRLIAGVLAGQEFEVTMVGDNSLSKRPMDRIALPLSKMGARISGVTNRDLPPLKLQGTKKLKPIFYHLPVASAQVKSALIFAALQTKGESLIVEKEQTRNHTEDMIRQFGGHLDIKDKEIRLNGGQSLVGQDIRVPGDISSAAFWIVAGLIIPNSHIILENVGINETRTGILDVVSKMGGKIKLSSVDNQVKSATLTVDYSHLQATHISGAMIPRLIDELPIIALLATQAQGTTVIADAQELKVKETDRIQVVVESLKQMGADITATADGMIIRGNTPLHAASLDCHGDHRIGMMIAIAALLVKEGEVDLSGEEAINTSYPNFLEHLEGLVNA

SEQ ID NO: 9675 - DNA, 1353 bp, Streptococcus agalactiae
atgttacataaaaatgatattattgaaactgaaattagcgacattagccatgagggaatgggtattgccaaagtagatggctttgttttctttgttgaaaatgctcttccaggtgagattattaagatgcgcgtcttgaaattacgtaagcgtataggatatggaaaagttgaggaatatttaacgacttctcctcaccgaaatgaaggattagactatacctatttacgtacagggattgctgatttgggacatcttacttatgaacaacagctgttatttaaacaaaaacaagtagctgataacctttataaaattgctcatatatctgatgttttagtagaacctactcttggtatgacaatccctttggcatatcgaaataaagctcaggtaccagttcgtcgtgttgatggacagctagagacaggttttttcagaaaaaattcacatactctggtatccattgaagattatttaattcaggaaaaagagattgatgctctgattaattttacacgagatttattaagaaaatttgatgttaaaccatatgacgaagagcagcaatctggtttaattagaaatctcgttgttcgtcgaggacattatacagggcaattaatgttggttttggtgacaacacgtcctaaaatattccgcattgaccaaatgattgaaaagttggtgtctgcctttccttctgttgtttcaattatgcaaaatattaatgatcgtaatagcaacgttatttttgggaaagaatttcgtactctatatggttctgatactattgaggaccaaatgttaggaaatacttacgctatatcagcccaatctttttaccaagttaatactgaaatggctgaaaaactgtaccaaaaagcaatcgatttttcagatttaaactcagaggatatcgttattgatgcctattcaggtataggaacaattggcttatctgttgctaaacaagtaaaacatgtttatggtgttgaagttgttgaaaaagcagtaagtgatgccaaagaaaatgctactcgaaatgggataactaacagtacctatgttgctgattcggctgaaaatgcaatggcaaagtggcttaaagaaggtataaaaccaactgttataatggttgatccaccacgaaaaggattaacggagagttttgtatattctgctgcccaaacaaaagcagataaaatcacttatatttcttgtaattcagcgacaatggcgcgtgatatcaaactatttgaagaattagggtatcatttagtaaaaattcaaccagtagacttattcccaatgacacatcatgtggagtgtgtggctctgctcgtaaaagcc

SEQ ID NO: 9676 - protein, 451 aa, Streptococcus agalactiae
MLHKNDIIETEISDISHEGMGIAKVDGFVFFVENALPGEIIKMRVLKLRKRIGYGKVEEYLTTSPHRNEGLDYTYLRTGIADLGHLTYEQQLLFKQKQVADNLYKIAHISDVLVEPTLGMTIPLAYRNKAQVPVRRVDGQLETGFFRKNSHTLVSIEDYLIQEKEIDALINFTRDLLRKFDVKPYDEEQQSGLIRNLVVRRGHYTGQLMLVLVTTRPKIFRIDQMIEKLVSAFPSVVSIMQNINDRNSNVIFGKEFRTLYGSDTIEDQMLGNTYAISAQSFYQVNTEMAEKLYQKAIDFSDLNSEDIVIDAYSGIGTIGLSVAKQVKHVYGVEVVEKAVSDAKENATRNGITNSTYVADSAENAMAKWLKEGIKPTVIMVDPPRKGLTESFVYSAAQTKADKITYISCNSATMARDIKLFEELGYHLVKIQPVDLFPMTHHVECVALLVKA

SEQ ID NO: 9677 - DNA, 747 bp, Streptococcus agalactiae
ttggataatcaaatttataaaaaacaaatacttgagatttataccaaagcaaacaaaagacttggtgtgaagtctatcaaagtcattcttcaaagagactacgacacaaaaatctctgaaggaagaatttaccatctgatgaagaatatggcgctccctaaaatggctaccgttaagacaaaaacagctcttaaaaagactcaaaaaacgtatcctcaaaacttactcaaccagaaattttatcctgacaaacctaatcaagtatggtctactgacttcacctatatttctattggatataagaaatatgtctatctctgcgcaatacttgatctctattctagaaaatgtattgcttggaaattgagtcaccgtatggatgcaaagttagcatgtaacactctagaattagctcttaataaaagaaagattgaaggaacacttctctttcattccgaccaagggtcacaatttaaggccagggaatttagaaaaataattgatgacaacaatatcatgcattctttttctaaacctggatatccttatgataatgccgtaactgaagcatttttcaagtatttaaagcatagacaaatcaaccgaaaacattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 9678 - protein, 249 aa, Streptococcus agalactiae
MDNQIYKKQILEIYTKANKRLGVKSIKVILQRDYDTKISEGRIYHLMKNMALPKMATVKTKTALKKTQKTYPQNLLNQKFYPDKPNQVWSTDFTYISIGYKKYVYLCAILDLYSRKCIAWKLSHRMDAKLACNTLELALNKRKIEGTLLFHSDQGSQFKAREFRKIIDDNNIMHSFSKPGYPYDNAVTEAFFKYLKHRQINRKHYQNIKQVQLDCFEYIENFYNNYIPHTANLGLTPNQKEENYFNAIK

SEQ ID NO: 9679 - DNA, 1206 bp, Streptococcus agalactiae
atggttacattcgattttaaacatgttcaaacattgcataccatatctcaactacctatttcagtcatgtcacgagacaaggaactcgttcagttatatggtaacgaagactatctgttgccttactatcagtttttaaaacatttagctatcccttataaccaagatatcactgtttatgagggtctttttgaagaatcattcttaatttttcctgtctgtcaatatcttattgctattggaccattttatccctatagccctgatatcaataggcaagaacagttatccagtcgctttctagaacaattttctcatcgtaataaaaaagaaatcttatcctatataaagcttgtcccttgttttcctactaccagtatacgtagtcttcttgtgtctatcgatgcctttttccaaacacagtttgaggctagttgccaacaagtcatcaatcatttattagaagagtcagaacagattgttgcggatcctgatattgttcttcacctaaaacatactaagaaaaactcttttcagttacccactgttttaaaccatctcaatcacattattgatctcgttaagctgggtaacactcaactgttaaagcaagaaattaatcgcctcccatcatccagtgttacctcatcttcaatccctgccctaagagctgaaaagaacttaactgttgtttacttaacaaaattactagaattaagtttcgaggaaaatactgatgtggctaaaagttatgcgctggtaaagcactatatggctttaaacgaagaggctcctgatcttattgatgtttcaagaattcgctgtgcagctcttattgatttttcagaatccttaaccaataagagcatctctgacaagcagcaaatgtacaatagtattctccattatgtggacaaccacctctactccaaactcaaagtatctgatattgccaactacctatatatctcagattcccacttacgctcagtttttaaaaaatactctgacatttccttgcaaagttatattctaaaggcaaaaattaaggagggacaattactactgcaaagaggggtaccgattggggaagtagcgaaattattacatttttacgacaccacacattttcttaaaacctttaaaaaatacgtgggaatatcttcaaacgaatatcttactaaatatcgtgagacctcatgccag

SEQ ID NO: 9680 - protein, 402 aa, Streptococcus agalactiae
MVTFDFKHVQTLHTISQLPISVMSRDKELVQLYGNEDYLLPYYQFLKHLAIPYNQDITVYEGLFEESFLIFPVCQYLIAIGPFYPYSPDINRQEQLSSRFLEQFSHRNKKEILSYIKLVPCFPTTSIRSLLVSIDAFFQTQFEASCQQVINHLLEESEQIVADPDIVLHLKHTKKNSFQLPTVLNHLNHIIDLVKLGNTQLLKQEINRLPSSSVTSSSIPALRAEKNLTVVYLTKLLELSFEENTDVAKSYALVKHYMALNEEAPDLIDVSRIRCAALIDFSESLTNKSISDKQQMYNSILHYVDNHLYSKLKVSDIANYLYISDSHLRSVFKKYSDISLQSYILKAKIKEGQLLLQRGVPIGEVAKLLHFYDTTHFLKTFKKYVGISSNEYLTKYRETSCQ

SEQ ID NO: 9681 - DNA, 990 bp, Streptococcus agalactiae
atgtcaatgattgaagtttctcaccttcagaaaaattttataaaaaccgttaaagcaccagggttaaaaggagcatttcaatcatttcttcgtcctgaaaaacacacctttgaagctgttaaagatttaacatttgatgtgcctaaaggacaaattctgggatttattggagcgaacggtgcaggaaaatctacaacaattaaaatgttaactgggattttaaaaccaacttcgggcttttgccgtattgatggcaaattgccacaagaaaaccgacaaaattatgttaaggatattggagtcgtttttgggcaacgtacgcagttatggtgggatttagctctacaagaaacctatacagtgttaaaagaaatctatgacgttcctgataaagaatttcgcaaacgcatggcttttttaaatgaggttttggaactaaatgactttataaaggatcctgttagaactttgtctctcggacagcgtatgagagcggatatcgcagcttctttattacataacccaaaggttcttttcttagatgaacccaccattggcttggacgtttcagtgaaagataatatccgacgtgcaatcacacaaattaatcaagaagaagagacaacgattttactaacgacacatgacctcagtgatattgaacaactttgtcatcgtatttttatgattgatagaggacaagaaatatttgatggcacagtttctcagctaaaagagacatttggaaagatgaaaactctttcttttgatttgcgcccaggacaagagcatatcagctctagtttaattggaaagtcggagattaatattaaacgtaatgacttagttttagatattcagtatgatagttctcgctaccaaactgctgacataattcagcagacattagcagatttttctgtacgtgaccttaaaatgacagatgcggatattgaagatatcattcgtcgcttctatagaaatgagcta

SEQ ID NO: 9682 - protein, 330 aa, Streptococcus agalactiae
MSMIEVSHLQKNFIKTVKAPGLKGAFQSFLRPEKHTFEAVKDLTFDVPKGQILGFIGANGAGKSTTIKMLTGILKPTSGFCRIDGKLPQENRQNYVKDIGVVFGQRTQLWWDLALQETYTVLKEIYDVPDKEFRKRMAFLNEVLELNDFIKDPVRTLSLGQRMRADIAASLLHNPKVLFLDEPTIGLDVSVKDNIRRAITQINQEEETTILLTTHDLSDIEQLCHRIFMIDRGQEIFDGTVSQLKETFGKMKTLSFDLRPGQEHISSSLIGKSEINIKRNDLVLDIQYDSSRYQTADIIQQTLADFSVRDLKMTDADIEDIIRRFYRNEL

SEQ ID NO: 9683 - DNA, 957 bp, Streptococcus agalactiae
ttgcctcaggaaggatgttggtatcagaaaatggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtt

SEQ ID NO: 9684 - protein, 319 aa, Streptococcus agalactiae
MPQEGCWYQKMEIKLKNIGKKYGSFEALRDINLIFEEGKFYGLLGPNGAGKTTLFNLLIQNFKQTSGDIKWEVDGKPLSIKDFYRHIGIVFQSNRLDDNLTVEENLISRGALYGLSKSQVRNRLKDLQTYLDITAIKKQKYGSLSGGQKRKVDIARALLPQPSLLLLDEPTTGLDPQSRRDLWDAIAQLNQQSQMTVVLITHYLEEMSACDVLNVLIEGNIYYSGDIKSFIEQHSTTNLNVVLKPEKSLDQLSIADFVNKCQVLSEREIVFKDISVEEMMQVISDNQDKSIIETFNVEYSNLEAAYLNLLREKERKNNV

SEQ ID NO: 9685 - DNA, 696 bp, Streptococcus agalactiae
atggttaattattggctcattgcaggtttgacgactattatttcaatgactagtacattaggtgcctttggagttatggtgtccgacaaagaaaaaaaattaaatgaagattttaaggtcagtcctatatcaaatatcaaaattgaattgtcctatgctatatttgccgttttatttggtattgtcatgacgatgttctcttgcatctttgctatcggtatttttaacggctttaattccttgctagagtattcagctatggattatttaactattttagggatcgtttccttagggactgttttatctgcggcgatgattttacctattttagcctttattcatactagttcagcttttacgactcttagcacaattgtagggacttttattggttttatttcaggagtatatctctcaattggctcggtaggaaaagcattacaacaggttatgacatggtttccattgactcaaatcaattctcttttgaaacaggtcttaatgaagggttctattgcgaaggtatttgacaaagccaacgaagccactgtctctaactataaagaatcatatggtgttgttttgcgtaatgctgatggagaaaggctgagtaatcactttatgttgatttatatcattgccctcattcttattttattggcaattcattttattattaaaaaggttaaaaaa

SEQ ID NO: 9686 - protein, 232 aa, Streptococcus agalactiae
MVNYWLIAGLTTIISMTSTLGAFGVMVSDKEKKLNEDFKVSPISNIKIELSYAIFAVLFGIVMTMFSCIFAIGIFNGFNSLLEYSAMDYLTILGIVSLGTVLSAAMILPILAFIHTSSAFTTLSTIVGTFIGFISGVYLSIGSVGKALQQVMTWFPLTQINSLLKQVLMKGSIAKVFDKANEATVSNYKESYGVVLRNADGERLSNHFMLIYIIALILILLAIHFIIKKVKK

SEQ ID NO: 9687 - DNA, 2154 bp, Streptococcus agalactiae
ttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaagg

SEQ ID NO: 9688 - protein, 718 aa, Streptococcus agalactiae
MGKNYSEHKQHLFDLKEGISKHLYKNHDSILESYTGSITSDPEVPEQYKDETRNFKFAFTAFEEALASSGVNLKAYHNIAVCLGTSLGGKSAGQNALYQFEEGERQVDASLLEKASVYHIADELMAYHDIVGASYVISTACSASNNAVILGTQLLQDGDCDLAICGGCDELSDISLAGFTSLGAINTEMACQPYSSGKGINLGEGAGFVVLVKDQSLAKYGKIIGGLITSDGYHITAPKPTGEGAAQIAKQLVTQAGIDYSEIDYINGHGTGTQANDKMEKNMYGKFFPTTTLISSTKGQTGHTLGAAGIIELINCLAAIEEQTVPATKNEIGIEGFPENFVYHQKREYPIRNALNFSFAFGGNNSGVLLSSLDSPLETLPARENLKMAILSSVASISKNESLSITYEKVASNFNDFEALRFKGARPPKTVNPAQFRKMDDFSKMVAVTTAQALIESNINLKKQDTSKVGIVFTTLSGPVEVVEGIEKQITTEGYAHVSASRFPFTVMNAAAGMLSIIFKITGPLSVISTNSGALDGIQYAKEMMRNDNLDYVILVSANQWTDMSFMWWQQLNYDSQMFVGSDYCSAQVLSRQALDNSPIILGSKQLKYSHKTFTDVMTIFDAALQNLLSDLGLTIKDIKGFVWNERKKAVSSDYDFLANLSEYYNMPNLASGQFGFSSNGAGEELDYTVNESIEKGYYLVLSYSIFGGISFAIIEKR

SEQ ID NO: 9689 - DNA, 1209 bp, Streptococcus agalactiae
atgagtaaatttttatttgctcctttcatgatgaatttaggagagagccaaagattatcaaaactggctaattgtttatatgaacaaggacatgatattcatatccttggagacaattattatccatttttatttaataatgatgcttatcgctatcaccactgtgtagaagataaatctgtttataatagtaagcgatatgatgctttcttttctctttcaacagactttaattttttatcagaagaagaaattgaacgcatctgttctattgaaagagacttgttacgccaagaaaaatttgatgctgtattgacaggttaccgtctatctattgttacaagttgtcgtttagaaagcataccattaatttggattatttcaggggcaacgcatatcagtgaaattgttgaaaactcagaaggaatattgcctaatgggaagataagtaaagctagtaagcctcaaacaaaggattttatcaaaagagtaatcactacttattcaacaaatgttaaaacgtggaataactatattaaaaaatatggtggcaaaacttttaataatgctttagaattatttactggtgatctaaacttggtaacagattactctttgttttatgaatttgataaagattcgtcctataaaacgataggacctattttgatagataatgtaggtttttcaaaatgcagccaaattaatcaagacaataagactgtactgctcagctttggtacttcatttaaacgagattgggtggaatcttttttaaagacattaccaaggcattatcattatttactgacaagctgtggtgaggctataaacattccaggaagttatattgagatagttgattttattgattttaaaaccatagataaagagatttatttcgctattatacacggtgggcaaggaacagtttatgcgatggctgcacaaggtattccctttataggtatccctttctttaacgaacaattttggaatattaagaagttcagtaaagaaaagtgcgcttatttggtaaagaaacctgatgtaagagagatacgtaaagcaattagctgtcttgaaagagactatgatatctataaaagttatatgataagactaagccaaggaattaaagaagaagcagaggcatctttacaaaaagcggaggcagaaattgaatcctttatcagaaaaagacaaagt

SEQ ID NO: 9690 - protein, 403 aa, Streptococcus agalactiae
MSKFLFAPFMMNLGESQRLSKLANCLYEQGHDIHILGDNYYPFLFNNDAYRYHHCVEDKSVYNSKRYDAFFSLSTDFNFLSEEEIERICSIERDLLRQEKFDAVLTGYRLSIVTSCRLESIPLIWIISGATHISEIVENSEGILPNGKISKASKPQTKDFIKRVITTYSTNVKTWNNYIKKYGGKTFNNALELFTGDLNLVTDYSLFYEFDKDSSYKTIGPILIDNVGFSKCSQINQDNKTVLLSFGTSFKRDWVESFLKTLPRHYHYLLTSCGEAINIPGSYIEIVDFIDFKTIDKEIYFAIIHGGQGTVYAMAAQGIPFIGIPFFNEQFWNIKKFSKEKCAYLVKKPDVREIRKAISCLERDYDIYKSYMIRLSQGIKEEAEASLQKAEAEIESFIRKRQS

SEQ ID NO: 9691 - DNA, 1083 bp, Streptococcus agalactiae
atgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaat

SEQ ID NO: 9692 - protein, 361 aa, Streptococcus agalactiae; identical to SEQ ID NO: 8764

SEQ ID NO: 9693 - DNA, 858 bp, Streptococcus agalactiae
atgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaattaccagatgttgatgataagactaacgaacagtatctgtcaattgcgaaaaaaattaacggcaataagtctcaacgagatgaagatgagcgcttaggtgataatcttggtaaattgaagaatgtaaaattccctaaagggatgccaactaagtattttcttgctgatcaatctgtggagggaatcaagctacgtcaagcagattttaaaggtttgaaaaattgggatcagcagcatattgatttatctgaagatccaaaagatgcttccgttgaaatttttaaaggtagtcacaatattttccaaacacaatatgaacatatggctaaagctattgatggatttatccaatcccatcaaaag

SEQ ID NO: 9694 - protein, 286 aa, Streptococcus agalactiae
MHPQGAVDLTKYKAKPVKDYGKKIDVGDGKKMNIYETGQGKIPIVFIPGQAEISPRYAYKNLIERLSKKYKIYTVEPLGYGLSDIPTKPRTLENITKEIHTGLNKIGVKNFYLAAHSLGGMYSLNYAKNYPEEVRGFIGMDTSTPWMEGEQKTKYDPESAKWAMKLPDVDDKTNEQYLSIAKKINGNKSQRDEDERLGDNLGKLKNVKFPKGMPTKYFLADQSVEGIKLRQADFKGLKNWDQQHIDLSEDPKDASVEIFKGSHNIFQTQYEHMAKAIDGFIQSHQK

SEQ ID NO: 9695 - DNA, 1227 bp, Streptococcus agalactiae
gtgaacctatggacattaagtttagcttatttgaaacgtcaaaaaatgaaaacagtaaccttgttcttagtttttctaactataggcacatgtttaatcagtctgatgagtattcagcattctttggaaaaaaatatcctaacaaaacaagggaaaagcatttatttaacctccaaagaaaaggcttattggcctgaacaagcatacgaagctttgaaaaaagcaaaaatggttgagtcagtagaggcaagtttaagcattgatgttggtagccgtttaaaatctgtatcaccatataactcttctaaagaagagaatcaagttacattagcaggttatcaaagtacagaagatttacgagcttttcagacaaaagcattggtcttaaagaaaggaagccatttagcggccgataatacaaaacaagtactagttccattgaagttagcacaaaagaatcatttaagtgtgggtaacaaattgagattaggcaaagaaaatgttactattgcaggaatttatgatgcgaatagtgctaagtctaaaaatacttttaatcccaatattgataatacattgattgctcaggcaacattggttaggaagattagtaaacaaaaaggttatcagacggttgcagtgcgcttaagtgataaacgtttagtggatacagttatccaaaacatcaaacaatggccgcttgatttcgggaaattagatgttcaaacagctaaagagttttatggagattcttatcgtaatatcgagacattgcatcgtctagtgggacgaatcattcttattgttagtctcgtggcgatggcaatattagttgtcatgctaacattttggattaataaccgcattaaagagacgggaattttactcgctatcggaaaaactaagtttgaaatcataggtcattatctgatagaagtactgttagtagcaggtgctgccttcacactatctattattggtggtgtctttcttggaaaaacatttgcagctggccttttatcacaagttaatggtggtgtgagttcacaaattgtacaaaatagtagtctaattattgatagaattgataacctcgctgtttctgttggagtaatggatgtctttagactctatgctcagggtgctttaatttgcttatttgcagttgtattatctagttattctattcttaaactacaaccaaagcaaatattgtcacgaatgtca

SEQ ID NO: 9696 - protein, 409 aa, Streptococcus agalactiae
MNLWTLSLAYLKRQKMKTVTLFLVFLTIGTCLISLMSIQHSLEKNILTKQGKSIYLTSKEKAYWPEQAYEALKKAKMVESVEASLSIDVGSRLKSVSPYNSSKEENQVTLAGYQSTEDLRAFQTKALVLKKGSHLAADNTKQVLVPLKLAQKNHLSVGNKLRLGKENVTIAGIYDANSAKSKNTFNPNIDNTLIAQATLVRKISKQKGYQTVAVRLSDKRLVDTVIQNIKQWPLDFGKLDVQTAKEFYGDSYRNIETLHRLVGRIILIVSLVAMAILVVMLTFWINNRIKETGILLAIGKTKFEIIGHYLIEVLLVAGAAFTLSIIGGVFLGKTFAAGLLSQVNGGVSSQIVQNSSLIIDRIDNLAVSVGVMDVFRLYAQGALICLFAVVLSSYSILKLQPKQILSRMS

SEQ ID NO: 9697 - DNA, 579 bp, Streptococcus agalactiae
atgtcggatgttgtcgaaaaacaaacaactaaatcgtttataatgaacgtattaaatggtttagctttagggactgttattgtcttgataccaggagcaatccttggagaattaatgaaagctttactgccaatgtggagcggctttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaacatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggacacgccgtacgcatgaaaactttctcttcatccttttgtgcccggacatcaattttgaaaagattcctttt

SEQ ID NO: 9698 - protein, 193 aa, Streptococcus agalactiae
MSDVVEKQTTKSFIMNVLNGLALGTVIVLIPGAILGELMKALLPMWSGFATLIAATAVATSMMGLVIGIMVGLNFKFNPIQSASLGLAVMFAGGAATFLKGAIMLKGTGDIINMGITAALGVLLIQFLSDKTKSFTLIVIPTVTLLLVGGVGHVLLPYVKMITTMIGQGTRRTHENFLFILLCPDINFEKIPF

SEQ ID NO: 9699 - DNA, 1023 bp, Streptococcus agalactiae
atggcaaaaattatttcattaggtgaggttcttttgcgattatctccacctcaatatcacacactgatgcaggctaatcacctaaaatgccaattcggtggttcagaacttaatgtcttagcaagccttgctcaactaggttaccatgtaggattggtctcagctttgcctgataatgatttgggcaagatggcaagtcaatttatattgtcacagcaaattagtccagctgctataattaaaaaagaaggacgactaggaatttattactatgaacaaggattttcggtaagaacaaataaggttatctacgatcgtaactattcatctttttgggaaagtaccttgagtgattatgattttacttctatttttaagggagtggattggtttcatgtttctggaattactccagcactaaccaaggacttatatgaggtgactcggttccttatgacaaaagctaaagaaggaggtgtaaaagtatcgattgatctcaattttcgtgagagtttatggtcatcttttcaagaggcacgtgagcaattatcgccactattaggattattagatgtttgctttggcttagagccgatttatttagctggcgaaagtgaagatttaaaagatgagttgggcttatccagaccttaccttgatattgaattacttgaaaagataacccaaaagattgtccaagaatatgggttagactatattgcctttactcaaagggaaatggaatatactaatcagtatatgttaaaatcatatttgtatcataataatatgttatatcaaactgataaaactggcgttgaagtattagatcgtgtggggacaggagatgcctttgctgcaggtttaattcatgcgcttctggaaaaagaaactcctcaaagggccttagaaatagctatggctacatttaaatacaaacataccattcaaggagatatcaatatcatgacacgagatgatattgcttacctcattgaaaaagaaacaaatgatattaaacga

SEQ ID NO: 9700 - protein, 341 aa, Streptococcus agalactiae
MAKIISLGEVLLRLSPPQYHTLMQANHLKCQFGGSELNVLASLAQLGYHVGLVSALPDNDLGKMASQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLLDVCFGLEPIYLAGESEDLKDELGLSRPYLDIELLEKITQKIVQEYGLDYIAFTQREMEYTNQYMLKSYLYHNNMLYQTDKTGVEVLDRVGTGDAFAAGLIHALLEKETPQRALEIAMATFKYKHTIQGDINIMTRDDIAYLIEKETNDIKR

SEQ ID NO: 9701 - DNA, 1797 bp, Streptococcus agalactiae
atgttatatccattattgacaaaaacaagaaatacttatgatttaggcggtatttggaactttaaattaggagaacataatccaaatgaattactaccttcagatgaagtcatggttatcccgacttcatttaatgatttgatggtaagtaaagaaaaacgtgattatataggtgatttttggtatgaaaaagtcattgaagtacctaaagtatcagaggatgaagagatggtgctgcgttttggctcagtgacacatcaagctaaaatttatgttgacggtgtattggtaggagagcataagggaggttttactccttttgaagttcttgttcctgaatgtaagtataataatgagaaaattaaggtatcaatttgtgctaataacgttttagactataccacgcttccggtcggaaattatagtgaaatcattcaagaagatggtagcattaagaagaaagtacgtgagaattttgatttcttcaattatgcaggtgtgcatcgtcctcttaagttgatgatacgtcctaaaaatcatatttttgatattacaattacaagtcgtctatcagatgatttacagtcagcagatttacattttttagtggagactaatcaaaaggttgacgaagttagaattagcgtttttgatgaagataacaaactagtgggtgaaacgaaggatagcagattatttcttagtgatgtccatctttgggaagttttaaatgcctatctgtacacagcgcgtgttgaaatttttgttgataatcaactccaagatgtctatgaggaaaattttggtcttagagaaatagaagtgacaaatggtcaattcctattgaatcgcaaacctatttattttaaaggatttggtaaacatgaagatacgttcattaatggcagaggtttgaatgaagctgctaacttaatggatttgaatcttttgaaggatatgggggcaaactcttttagaacatcccattatccttattctgaagaaatgatgcgtttagcagatcgaatgggagtgttagtgatagatgaggttccagcagtagggttatttcaaaattttaacgcttccttagatttgtcaccaaaagataatggtacgtggaatttgatgcaaacaaaagcggcgcatgaacaagctatccaagaattagtgaagcgtgataaaaatcatcctagcgtcgtgatgtgggtagtcgctaacgaaccggctagtcatgaagcgggagcacatgattattttgagccattagtaaaactttataaagatttagaccctcaaaaacgtcctgtcaccttggttaatattttaatggcaaccccagatagagaccaagtgatggacctggttgatgttgtctgccttaatcgttactatggttggtacgttgaccacggtgatttaacaaatgcagaagtaggtataagaaaagagttattagaatggcaagataaatttcctgacaaaccaattatcataacggagtatggcgctgatacgttaccgggattacattctacttggaatattccatatacagaagaatttcaatgtgatttttatgaaatgagtcatcgtgtttttgatggtattcctaatttagttggtgagcaagtctggaattttgcagactttgaaactaatctgatgatacttcgtgtacaggggaatcacaaaggtctcttttcaaggaatcgccagccgaaacaagtcgtcaaagaatttaaaaaacgctggatgactattcctcattaccataataaaaaaaatagtgtaaaa

SEQ ID NO: 9702 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEDEEMVLRFGSVTHQAKIYVDGVLVGEHKGGFTPFEVLVPECKYNNEKIKVSICANNVLDYTTLPVGNYSEIIQEDGSIKKKVRENFDFFNYAGVHRPLKLMIRPKNHIFDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDMGANSFRTSHYPYSEEMMRLADRMGVLVIDEVPAVGLFQNFNASLDLSPKDNGTWNLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGIRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 9703 - DNA, 615 bp, Streptococcus agalactiae
atgttaaatcaattgaaaaacaactatttctttgctgttattcgagggaaatcatctgaggatgcgctcgaaatcgcaaagcatgctattttgggtggtattcggaatattgaagtaactttttcgactcctgaagcaagcaaagtcatcaaacaattatcagatgactttaaaaataataaagaaattattgtgggggccggaacggtcatgacaactgaacttgctaaagaggctattgatgctggagctaaatttttggttagcccacactttgattcagatattgctaatttagctaatgaaaacaaggtttattatttcccaggctgtgcaacggcaacagaaatcgtggtagctagaaagtataaatgtcagattataaagctttttccaggtggagttgtgggtccaggttttatcaaagatattcatggtcctattccagatgttgatttaatgccatcaggtggcgtctctgtttcaaatgtagttgaatggagaaaagcaggagcagttgcggttggtgttggctcagcattatctagtaaagtagccacagaaggctatgatagtgttactaaaatagctaaacagtttgtttctgcacttgat

SEQ ID NO: 9704 - protein, 205 aa, Streptococcus agalactiae
MLNQLKNNYFFAVIRGKSSEDALEIAKHAILGGIRNIEVTFSTPEASKVIKQLSDDFKNNKEIIVGAGTVMTTELAKEAIDAGAKFLVSPHFDSDIANLANENKVYYFPGCATATEIVVARKYKCQIIKLFPGGVVGPGFIKDIHGPIPDVDLMPSGGVSVSNVVEWRKAGAVAVGVGSALSSKVATEGYDSVTKIAKQFVSALD

SEQ ID NO: 9705 - DNA, 837 bp, Streptococcus agalactiae
atgtcaaaaacaattacatttaccaataaagttgtcgtcataacaggtgcaggcggtgttctctgtggttatatggctaaagaatttgcgaaagcaggcgctaaagtggcattattagatttgaatcaagaagctgctcaaacatttgctgatgaaattgtagaagaaggtggtatcgctaaggcttataaagctaacgttttgtctaaagaaaaccttgaagaagtgcatcaagccgttttagaggatcttggaccaactgatattttagttaatggtgcaggaggcaacaatcctaaagctacaactgataatgaatttcacgaattagacttaccttcagaaacaaaaaccttctttgagttagatgaagctggtattagctttgtttttaacttaaattatttaggaacattattgccaacgcaagtatttgcccaagatatggttggacgtgaaggagcgaatattattaatatctcttcaatgaatgcttttacccctctgaccaaaataccagcttattctggagctaaagcagctattagtaacttcacacaatggctagctgttcatttctcaaaagttggtatccgttgtaatgctattgcacctggtttcttggtaacaaatcagaaccgaagcttgttatttactgaggacggtcagccaactgcgcgtgctgagaaaattcttaataatacaccaatgggaagatttggagaagcaagtgagctgattggcggattgttctttttagcagatgaaaaatcatcaagttttgttaatggcgttgtccttccgattgatggtggatttgctgcttactctggtgtt

SEQ ID NO: 9706 - protein, 279 aa, Streptococcus agalactiae
MSKTITFTNKVVVITGAGGVLCGYMAKEFAKAGAKVALLDLNQEAAQTFADEIVEEGGIAKAYKANVLSKENLEEVHQAVLEDLGPTDILVNGAGGNNPKATTDNEFHELDLPSETKTFFELDEAGISFVFNLNYLGTLLPTQVFAQDMVGREGANIINISSMNAFTPLTKIPAYSGAKAAISNFTQWLAVHFSKVGIRCNAIAPGFLVTNQNRSLLFTEDGQPTARAEKILNNTPMGRFGEASELIGGLFFLADEKSSSFVNGVVLPIDGGFAAYSGV

SEQ ID NO: 9707 - DNA, 945 bp, Streptococcus agalactiae
atggcaactgttagtcgtgtggtaaatggaaataaaaatgtcaaggaaaatacacgtaagaaagtccttgaagttattgatcgtcttgactatcgtccaaatgctgtggcgcgtggtttagcaagtaaaaaaacgacaactgttggtgttgtcattcctaatatcgcaaatagctacttttcaattttagcgcgtggtattgatgatattgcagcaatgtacaaatataacattgtccttgcttcaagtgatgaagacgatgataaagaggttaatgttgttaatactttgtttgctaagcaagtagacggtattatttttatgggacaccacttaactgaaaagattcgtgcagagttctctcgttcacgcacaccgattgttttagcaggtactgtggaccttgagcatcaattaccaagtgttaatatcgattacaaagcagcagcagttgatgttattgatattttagctggcaatcataaagacattgcttttgtatcaggaccacttattgacgatattaatggcaaggttcgtttggcaggatacaaagaaggtctcaagaaaaatggcttaaactttaaagaggggttggtttttgaagccaactaccgttatgctgaaggctttgcattagctcaacgcgtgattaatgctggagcaacagcagcatatgttgctgaggatgagttagcggcaggtttgttaaatggtctttttgaggcaggtaaacgtgttcctgaagattttgaaattatcacaagcaatgactcgccaatcgcacaatatacacgtcctaacttaacttctatcagtcaaccggtctatgatttgggtgctgttagcatgcgtatgctaacaaaaattatgcacaaagaagagttggaagaaaaagaaatagtgcttaatcacgggattgttaaacgtggcacaacaaataat

SEQ ID NO: 9708 - protein, 315 aa, Streptococcus agalactiae
MATVSRVVNGNKNVKENTRKKVLEVIDRLDYRPNAVARGLASKKTTTVGVVIPNIANSYFSILARGIDDIAAMYKYNIVLASSDEDDDKEVNVVNTLFAKQVDGIIFMGHHLTEKIRAEFSRSRTPIVLAGTVDLEHQLPSVNIDYKAAAVDVIDILAGNHKDIAFVSGPLIDDINGKVRLAGYKEGLKKNGLNFKEGLVFEANYRYAEGFALAQRVINAGATAAYVAEDELAAGLLNGLFEAGKRVPEDFEIITSNDSPIAQYTRPNLTSISQPVYDLGAVSMRMLTKIMHKEELEEKEIVLNHGIVKRGTTNN

SEQ ID NO: 9709 - DNA, 1017 bp, Streptococcus agalactiae
atggcaaagaccgctcttaatattccttttacagttgaagggatagaaaattattatcaaaatataaaaatgatactgtctttagcagataaatggagcatacctaaagatgatctattactttttttaaagggcctcaaggctattgatgatataaaagttggctctcctatttttaagtatttttggacttctttaagtttacaagcacccctcaaagctttagaattcgtgttagagcaggctaaaatgccaactgaattgtcaggagaattatcagaaacacaatacttggtcgcacagttttcagatgagttagctccacatgatgatttctggatagccttatcacaagttatttatgattcttttcctgggaatagtctagccgaagatactgtattaaataggaaactccatcaattccgctatttgatttctagtcagcaagcacagtatgttcgacgatactttaaagatgttggtatgactgatagagatgctttagtaaactacctatcatgtttaagagaaccagatagtatcgcctactatgaatctgctcgcttgcataataaacgtcggagaaatggtgaaatctttggtttcccagatgatgagccggttattaatagtaagcttttaatttcattccatacggaatttattattgatgacaaaggaaactttttaaacgagattgacgcagaagtaataacacgtaatggtattatcaatggagctagctttaattatgcttttaaaaataatacacgtcataaagaattagatgttgatcctgtaaagttagacccaaaatttcgaaacgatatgactagaggttatagatcgccaaatctatctagaaggaaatggtttttctttaaagaagaggattacgattgtagttatttcaataaaaaaggatattacgcatttggaaggcgtagtgctaagcaatcggttgataaacaagtcaaatacttgaagaaggctgtgcagaaaatgcgcatcaac

SEQ ID NO: 9710 - protein, 339 aa, Streptococcus agalactiae
MAKTALNIPFTVEGIENYYQNIKMILSLADKWSIPKDDLLLFLKGLKAIDDIKVGSPIFKYFWTSLSLQAPLKALEFVLEQAKMPTELSGELSETQYLVAQFSDELAPHDDFWIALSQVIYDSFPGNSLAEDTVLNRKLHQFRYLISSQQAQYVRRYFKDVGMTDRDALVNYLSCLREPDSIAYYESARLHNKRRRNGEIFGFPDDEPVINSKLLISFHTEFIIDDKGNFLNEIDAEVITRNGIINGASFNYAFKNNTRHKELDVDPVKLDPKFRNDMTRGYRSPNLSRRKWFFFKEEDYDCSYFNKKGYYAFGRRSAKQSVDKQVKYLKKAVQKMRIN

SEQ ID NO: 9711 - DNA, 684 bp, Streptococcus agalactiae
atgaaagaattaagatcaaagctggaaaaagactatggtattgtttttgctaatcaagaattattagatacagcttttacccatacatcatacgcaaatgagcatcgcctcctaaacatttcacataatgaacgtttggaatttttaggagacgctgttctacaattacttatttcacagtatctttttacaaagtaccctcaaaaggcagaaggtgatttatcaaaattacgttcaatgattgttcgtgaggaaagtcttgcaggtttttcacgtctatgtggctttgatcactatattaaacttggaaaaggagaagaaaaatctggtggacgtaatcgtgacactattttaggagatttatttgaggcttttttaggagctttattattagacaaaggtgttgaagtggttcatgcctttgttaacaaggtaatgatccctcacgttgaaaaagggacctatgagcgtgttaaagattacaagacaagcttgcaagaattacttcaatctcatggggatgtaaaaatagattatcaagttactaatgaaagtggtccagcacatgcaaaggaatttgaggtgactgtatctgtcaaccaagaaaatttgagccaaggaattggacgatcaaagaaagctgctgaacaagacgctgccaaaaatgctttagcaacgttacaa

SEQ ID NO: 9712 - protein, 228 aa, Streptococcus agalactiae
MKELRSKLEKDYGIVFANQELLDTAFTHTSYANEHRLLNISHNERLEFLGDAVLQLLISQYLFTKYPQKAEGDLSKLRSMIVREESLAGFSRLCGFDHYIKLGKGEEKSGGRNRDTILGDLFEAFLGALLLDKGVEVVHAFVNKVMIPHVEKGTYERVKDYKTSLQELLQSHGDVKIDYQVTNESGPAHAKEFEVTVSVNQENLSQGIGRSKKAAEQDAAKNALATLQ

SEQ ID NO: 9713 - DNA, 3357 bp, Streptococcus agalactiae
atgccagacgttatatttgctggtacagaaaatcgtaagccccttaattatgcgcaagtgagtgttactttagataatagcgaccattttatcgaaaatatagctgacgaagttcgagttgaacgtcgtatttttcgaaacggagatagtgaatatttaatagatggacgcaaagttcgcttacgtgatattcatgatttatttatggatactggattaggaagagattctttttctattatttcccaaggacgcgttgaagctatttttaatagtaaaccagaagagcgccgtgccatatttgaagaagccgctggtgttctgaaatacaaaacacgtaagaaagaaacacaatccaaattagaacaaactcaagggaacttagatcgcttagaggatattatttatgaattggacatgcaagtccaaccattagaaaaacaagcaagtattgccaagcgttttttagtattagatgaggaacgacaaggactccacttatctattttgattgaagatattttacaacatcaatcagatttaactactgttgaggaaaagctattgacagtaagaaaagagttagcaacttattaccaacaacgtcagtcccttgaagatgaaaatcaatcgttaaaacagaaacgtcaccatttatctgaagaaattgaggctaaacagttagctcttttagacgttacaaagttaaagtcagatttggaacgccaaattgatctgattcgtttagagtcaaaccaaaaggctgaaaaaaaagaagaggcaggtcaacgcttagcagagttagaaattaaagctaaagattgtagtgaccagattacccaaaaaaatatagagttaactactctgtcggaaaaaatagcccaaataagatcagaaattgttagtacagaaagttccttggagcgtttttcaactaatccggatcagattattgaaaaacttcgagaagactttgttaccttgatgcaagaagaagccgacacttcaaacgctttaacagctttactagctgatatagagaatcaaaaacaagcttctcaagctaaatctcaagaaatacaagaagttagcaaaaatttagaagtattaaaaagtaacgcaaaggtagcattggaacgatttgaggctgcaaagaagaatgttcgtcagttattatctcactaccaagatttaggtcaaaccttgcaaaatctagaaggtgagtataagaatcagcagtcaattttatttgatcatttagatgaaatcaaatcaaagcaagcacgtatttcgagtttagaatctattttgaaaaatcatagtaatttctatgctggagtgaagtcagttctacaggctaaggaccagcttggaggtatcataggtgctgttagtgagcatcttagctttgacaaacattaccaaacagcattggagatagctttgggaggtagcagccaacacatcattgttgaagacgagagtgctgccaaacgttcaattgcttttttaaagaaaaaccgccaaggtagagcgacatttctgcctttaactacaataaaaccaagagaattagcacaacattatctctcaaaattacaaagttctcaagggtttttaggaatagctagtgaattggtaacctatgatcaacgcttgtcaaacatttttaaaaataacttagggttaactgctatttttgatacggttgataatgctaatgtagctgcgagacaattgaattatcaagtacgtttagtaaccttagatggaacagagttacgccctggagggtcgtactcagggggagcaaatcgtcaaaataatactgtttttatcaagcctgaattggataatctaaaaaaagaattgaaacaggcacaaagtaaacaattaattcaagaaaaagaagttgccacattgttagagcaactcaaagagaaacaagaaaccttagcacaacttaagaatgatggagaacaagctcgtcttgaggaacaaagagctgatatagagtatcaacaactatcagaaaagcttgctgatttaaataaactatataatggcttgcaattaagcagcggggcgttggaacaaactacttctgaaaatgaaaaaaatcgtttagaaaaagaacttgaacaatttgctattaaaaaagaagagttgacaacttcaattgctcaaattaaggaagataaagattcaattcaagaaaaagtcaataatctaacaacattattgtcagaggcacagctagaagaacgtgatttgctaaacgagcagaaatttgaacgtgccaactgtacacgtctagagattaccttgtctgaaataaaacgtgacattagtaatttacaaacattactaagccatcaggacagtcaattagacaaagaagagcttccacgtatagaaaaacagttgctacaagtaaataatagaagagaaaatgacgaagaaaagcttgtgagtctccgttttgaattggaggattgtgaagctgctttagatgatttagctgcttctctggctaaagagggacaaaaaaatgaaagtcttattcgtcagcaagctcaattagagtcacaatgtgaacaattatctcaacaattgatgatattctcacgtcaattatcagaagactatcagatgacattggatgaagcgaaggtaaaagcaaatgtcttggaagatattttgatggcgcgtgaacaattgaaatctctacaagctaaaattaaagctttaggacctgttaatattgatgcaattgctcaatttgaagaagttcatgaacgattgaccttccttaacacacagcgagacgacttagttcatgccaaaaatttattactagagacgattacagatatggatgatgaagttaagactcgttttaaatcgacatttgaagccattcgtcatagtttcaaagaaacctttgtacagatgtttggtggaggttctgcggaccttattctgacagaaggtgatttattatcagctggggttgatatttcggttcaacctcctggtaaaaaaatccagtctttaaacttgatgtcaggtggtgaaaaagcattatcagcgttagcattattatttgccattatccgtgttaagacaattccatttgtcatcttggatgaagttgaggccgctttagatgaagcaaatgttaagcgatttggcgattatcttaatcgatttgataaatcaagtcaatttatcgttgttactcaccgaaaagggactatgtctgctgctgatagtatctatggggtaacgatgcaagaatcaggcgtttccaaaattgtttctgtaaaattaaaagaagctcaagaaatgaccaat

SEQ ID NO: 9714 - protein, 1119 aa, Streptococcus agalactiae
MPDVIFAGTENRKPLNYAQVSVTLDNSDHFIENIADEVRVERRIFRNGDSEYLIDGRKVRLRDIHDLFMDTGLGRDSFSIISQGRVEAIFNSKPEERRAIFEEAAGVLKYKTRKKETQSKLEQTQGNLDRLEDIIYELDMQVQPLEKQASIAKRFLVLDEERQGLHLSILIEDILQHQSDLTTVEEKLLTVRKELATYYQQRQSLEDENQSLKQKRHHLSEEIEAKQLALLDVTKLKSDLERQIDLIRLESNQKAEKKEEAGQRLAELEIKAKDCSDQITQKNIELTTLSEKIAQIRSEIVSTESSLERFSTNPDQIIEKLREDFVTLMQEEADTSNALTALLADIENQKQASQAKSQEIQEVSKNLEVLKSNAKVALERFEAAKKNVRQLLSHYQDLGQTLQNLEGEYKNQQSILFDHLDEIKSKQARISSLESILKNHSNFYAGVKSVLQAKDQLGGIIGAVSEHLSFDKHYQTALEIALGGSSQHIIVEDESAAKRSIAFLKKNRQGRATFLPLTTIKPRELAQHYLSKLQSSQGFLGIASELVTYDQRLSNIFKNNLGLTAIFDTVDNANVAARQLNYQVRLVTLDGTELRPGGSYSGGANRQNNTVFIKPELDNLKKELKQAQSKQLIQEKEVATLLEQLKEKQETLAQLKNDGEQARLEEQRADIEYQQLSEKLADLNKLYNGLQLSSGALEQTTSENEKNRLEKELEQFAIKKEELTTSIAQIKEDKDSIQEKVNNLTTLLSEAQLEERDLLNEQKFERANCTRLEITLSEIKRDISNLQTLLSHQDSQLDKEELPRIEKQLLQVNNRRENDEEKLVSLRFELEDCEAALDDLAASLAKEGQKNESLIRQQAQLESQCEQLSQQLMIFSRQLSEDYQMTLDEAKVKANVLEDILMAREQLKSLQAKIKALGPVNIDAIAQFEEVHERLTFLNTQRDDLVHAKNLLLETITDMDDEVKTRFKSTFEAIRHSFKETFVQMFGGGSADLILTEGDLLSAGVDISVQPPGKKIQSLNLMSGGEKALSALALLFAIIRVKTIPFVILDEVEAALDEANVKRFGDYLNRFDKSSQFIVVTHRKGTMSAADSIYGVTMQESGVSKIVSVKLKEAQEMTN

SEQ ID NO: 9715 - DNA, 126 bp, Streptococcus agalactiae
atggctattacgcacaaacgtcaagatgacttagaaagtatgttcgctagttttgctaaagtaccaaaacctaaaaaagttgattctgattcaaaacctgaacagaaagatgattctcagaaagat

SEQ ID NO: 9716 - protein, 42 aa, Streptococcus agalactiae
MAITHKRQDDLESMFASFAKVPKPKKVDSDSKPEQKDDSQKD

SEQ ID NO: 9717 - DNA, 2217 bp, Streptococcus agalactiae
ttgaaatcgctttttaaaactcttcgtaagtcaaaaatatgctataataaaagcgttatggaaaatttaaatattacacaaattgctattgatttaggtattaaagcgtcacaaatcgaaaaggttttagaattaacagatgaaggaaatactattccttttattgcccgttatcgtaaagaaatgacaggtaatttggatgaagttcaaatcaaatcaattattgaccttgataagagtatgacagctctttcagatcgtaaaactacggtcttagccaaaattgaagaacaaggaaagttgactcaagaactcaaaaaggctattgaagaagcaactaaactagcagatgttgaggaactctacctaccttataaagaaaaacgtcgtacgaaagctacgattgcacgtgaagcaggtctttttcctttagcacgtcttattttacaaaataaggataaccttgaggaagaagctcaaaactatcttacagatggttttgagacaactacgaaggcactttctggagcagtagatattcttatcgaagctttttctgaggataataaattacgttcatggacatataatgagatctggaactacagctcaatcactgcagttgttaaagatgagtcacttgatgaaaaacaggtcttcaaaatctactatgacttttctgaaaaaataagtaaactccatggctatcaagttttagcattgaatcgtggtgagaaaatgggtgttcttaaggttaattttgagcataaccttgaaaaaatgtttcgcttttttgctgttcgatttaaagaaactagccaatatatagatgaccttattgtacagactgtcaagaaaaaaatcgttccagctatggaacgccgtatccgtacagaactaagtgaaggagcagaagatggtgcaatttcactgttttcagagaatcttcgtaacttattgttagtctcaccgcttaaggggaaaatggtgttaggttttgaccctgcctttcgtacaggagcaaaattagcagtagtagaccaaactggaaaattaatgacaacacaagtgatttatccagttcctccagctaatcaagcaaaaatcgaacaatcaaaaatagagttagcaaaacttatcaaagaattcaatatagaaattattgctatagggaatggaacagcgagtcgtgaatcagaagcatttgttgcagaagttttacaagattttccagacgtatcctatgtgattgttaacgaaagtggtgcctctgtttattcagcctcagaattggcacgtcatgaatttccagacttaacggttgaaaaacgttcggccatctcaattgcaagacgtctgcaagacccattagcagaactagtcaaaattgatccaaaatctattggtgtgggtcaatatcaacatgatgttagccaaaaaaaattagcagaaaatcttgattttgttgttgaaactgtagttaaccaagtaggtgttaatgttaatacagcaagtccagccttgttagctcatgtttcaggtttaaataaaacaatatctgaaaatattgttaaatatcgtgaagagaatgggcaaattaagtcacgtgctgaaattaagaaagtgcccagattaggagcaaaagcttttgagcaagctgctggattcttacgtattcctaatgctaaaaatttcttggataatacaggtgttcaccctgagtcttatgaagctgttaaaaagttgcttgaccaactgactatcaaagaattagatgatcttgctaaagagaagttacaaaaccttgacttaattgcaacagcagaaagtattggggtaggtcaagaaacattaaaagacattatagaagatcttttgaaaccaggtcgtgatttgcgtgatgattttgaagcgcctgttttgagacatgatgttttagatgtcagtgatttaaaagttggacaggaattgcaaggaactgttcgaaacgtcgttgattttggtgcttttgttgatattggtgttcatgaagatggtctaatccaccagtctcgccttattaagcgaaaacgcgataaaaaaactagaaaaatgcctcctttacaacatccaagcaaatatctctctgttggtgatattgtaactgtttgggttgtagaggtagatgcggagcgtagcagaattggacttagtcttatcaagccagacggacttgac

SEQ ID NO: 9718 - protein, 739 aa, Streptococcus agalactiae
MKSLFKTLRKSKICYNKSVMENLNITQIAIDLGIKASQIEKVLELTDEGNTIPFIARYRKEMTGNLDEVQIKSIIDLDKSMTALSDRKTTVLAKIEEQGKLTQELKKAIEEATKLADVEELYLPYKEKRRTKATIAREAGLFPLARLILQNKDNLEEEAQNYLTDGFETTTKALSGAVDILIEAFSEDNKLRSWTYNEIWNYSSITAVVKDESLDEKQVFKIYYDFSEKISKLHGYQVLALNRGEKMGVLKVNFEHNLEKMFRFFAVRFKETSQYIDDLIVQTVKKKIVPAMERRIRTELSEGAEDGAISLFSENLRNLLLVSPLKGKMVLGFDPAFRTGAKLAVVDQTGKLMTTQVIYPVPPANQAKIEQSKIELAKLIKEFNIEIIAIGNGTASRESEAFVAEVLQDFPDVSYVIVNESGASVYSASELARHEFPDLTVEKRSAISIARRLQDPLAELVKIDPKSIGVGQYQHDVSQKKLAENLDFVVETVVNQVGVNVNTASPALLAHVSGLNKTISENIVKYREENGQIKSRAEIKKVPRLGAKAFEQAAGFLRIPNAKNFLDNTGVHPESYEAVKKLLDQLTIKELDDLAKEKLQNLDLIATAESIGVGQETLKDIIEDLLKPGRDLRDDFEAPVLRHDVLDVSDLKVGQELQGTVRNVVDFGAFVDIGVHEDGLIHQSRLIKRKRDKKTRKMPPLQHPSKYLSVGDIVTVWVVEVDAERSRIGLSLIKPDGLD

SEQ ID NO: 9719 - DNA, 132 bp, Streptococcus agalactiae
atgatgacggttggttctggtaattcatataaaggagatttgctagatgaatctccttttttcttagctttatttagaccactttttcaaaatatcttctttttttcagaaaaacgcgttagcgcttacttt

SEQ ID NO: 9720 - protein, 44 aa, Streptococcus agalactiae
MMTVGSGNSYKGDLLDESPFFLALFRPLFQNIFFFSEKRVSAYF

SEQ ID NO: 9721 - DNA, 771 bp, Streptococcus agalactiae
atgattaatccagtagcaatacgattaggccccttttctattcgctggtatgctatttgcatagtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattat

SEQ ID NO: 9722 - protein, 257 aa, Streptococcus agalactiae
MINPVAIRLGPFSIRWYAICIVSGMLLAVYLAMKEAPRKNIKSDDILDFILMAFPLSIVGARIYYVIFEWAYYSKHPVEIIAIWNGGIAIYGGLITGAILLVIFSYRRLINPIDFLDIAAPGVMIAQAIGRWGNFINQEAYGRAVKNLNYVPNFIKNQMYIDGAYRVPTFLYESLWNFLGFVIIMSIRHRPRTLKQGEVACFYLVWYGCGRFIIEGMRTDSLYLAGLRVSQWLSVILVIIGIVMIIYRRREQHISYY

SEQ ID NO: 9723 - DNA, 624 bp, Streptococcus agalactiae
atgggtcaagtcagtcgtattcggaatggcataaagtcccaacaattaagtattgatgctcccaaactagtccctttattaagaaaaggggatagcgtagctgttaatggtgtttgtttgacggttcttgacaaaagtgaaacagcttttatagcagacgtcatgccagaaagtatgatgcgaacaagcttagctgctttacgacttcattctaaagttaacttagaattagcactcagaagtgactcaaggttaggggggcattttgttcttggacatgtggatggggttggaaaaatagaaaaaatccaaaaagatgatattgctgtcagattttcaattgatgctccacctagtattatgtcttatattatagagaaaggttcggtggctctagatgggattagcttaacagtggtatcatttacagagcattcttttgaagtttcggtcattccccacacgatggctcaaactaatctatccttaaaaaaggttggggatttattaaatatcgaagtggatgttttaggcaaatatgctgagaaatttttagcacccactaatagaactaatcacacttcatcggtaatggattggtcttttttatcagaaaatggctac

SEQ ID NO: 9724 - protein, 208 aa, Streptococcus agalactiae
MGQVSRIRNGIKSQQLSIDAPKLVPLLRKGDSVAVNGVCLTVLDKSETAFIADVMPESMMRTSLAALRLHSKVNLELALRSDSRLGGHFVLGHVDGVGKIEKIQKDDIAVRFSIDAPPSIMSYIIEKGSVALDGISLTVVSFTEHSFEVSVIPHTMAQTNLSLKKVGDLLNIEVDVLGKYAEKFLAPTNRTNHTSSVMDWSFLSENGY

SEQ ID NO: 9725 - DNA, 1191 bp, Streptococcus agalactiae
atggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagat

SEQ ID NO: 9726 - protein, 397 aa, Streptococcus agalactiae
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 9727 - DNA, 1488 bp, Streptococcus agalactiae
atgtctaaccaacatattgaagaattaaatgaccaacagattgttcgtcgtgaaaaaatggctgctttgactgaacaaggcattgatccttttggtaaacgatttgaacgtacagcaacatctggtcaattaaatgaaaaatacgctgacaaatcaaaagaagacttgcacgacattgaagaaactgctacaatcgctggtcgtttaatgactaagcgcggtaaggggaaagttggctttgcgcatatccaagatcgcgaaggtcaaattcaaatttatgtccgtaaagattctgttggcgaagaaaactacgaaatctttaaaaaagctgatttaggtgacttccttggtgttgaagggcaagtaatgcgtacagatatgggagaactttctatcaaggctactcatattactcacctttcaaaagcactccgtccacttcctgaaaaattccacggcctaactgatattgaaacaatctatcgtaaacgtcatcttgatttaatctcaaatcgtgacagctttgaccgttttgtaacacgctcaaaaatcatttcagaaattcgtcgctttatggatagcaatggtttcttagaggttgaaacacctgttcttcataatgaagctggtggtgcttctgctcgcccatttatcacacatcacaatgcacaagacattgacatggttcttcgtatcgcaactgaattgcatctaaaacgtcttattgtaggtggtatggagcgtgtttatgaaatcggacgtattttccgtaatgaagggatggatgcaacccacaatccagagttcacatctattgaagcctaccaagcctatgctgactaccaggatattatggacttgacagaaggtattatccagcatgttacaaaaactgtaaaaggtgatggaccaattaattatcaaggcacagaaattaaaattaatgaaccattcaaacgtgttcatatggttgatgcggttaaagaaatcactggtattgacttctggaaagaaatgactcttgaagaagcacaagctttggcacaagaaaaaaatgttccgcttgaaaaacatttcacaacagttggtcacatcattaatgccttcttcgaagaatttgttgaagacactttaattcaaccaacttttgtctttggtcatccagttgaagtgtctccacttgctaagaaaaatgatacagaccctcgttttacagaccgtttcgaactctttatcatgactaaagaatacgctaatgcttttacagaattaaatgacccaattgatcagctatctcgctttgaagcacaagcatctgctaaagaacttggcgatgatgaagcaactggagttgattacgattatgttgaagcacttgaatatggtatgccacctactggtggactaggtattggtatcgaccgtctctgtatgctgttaactgatacaacaactatccgagacgtcctacttttccctacaatgaaa

SEQ ID NO: 9728 - protein, 496 aa, Streptococcus agalactiae
MSNQHIEELNDQQIVRREKMAALTEQGIDPFGKRFERTATSGQLNEKYADKSKEDLHDIEETATIAGRLMTKRGKGKVGFAHIQDREGQIQIYVRKDSVGEENYEIFKKADLGDFLGVEGQVMRTDMGELSIKATHITHLSKALRPLPEKFHGLTDIETIYRKRHLDLISNRDSFDRFVTRSKIISEIRRFMDSNGFLEVETPVLHNEAGGASARPFITHHNAQDIDMVLRIATELHLKRLIVGGMERVYEIGRIFRNEGMDATHNPEFTSIEAYQAYADYQDIMDLTEGIIQHVTKTVKGDGPINYQGTEIKINEPFKRVHMVDAVKEITGIDFWKEMTLEEAQALAQEKNVPLEKHFTTVGHIINAFFEEFVEDTLIQPTFVFGHPVEVSPLAKKNDTDPRFTDRFELFIMTKEYANAFTELNDPIDQLSRFEAQASAKELGDDEATGVDYDYVEALEYGMPPTGGLGIGIDRLCMLLTDTTTIRDVLLFPTMK

SEQ ID NO: 9729 - DNA, 615 bp, Streptococcus agalactiae
atggaaatactgattgcaggtggtagtggttttttaggaaagcagataataaaagcagcgcttacaaaagggcataaagtggcttacttatcaagacatgaaggtaaaggtgatatatttaaggatcctagattaacctacattaggggagatattacagaagctgataagattcatttagaagacagaacttttgatatattaattgactgtattggagcgattaagcccaatcaactagatgagcttaacgttaaagcaacccaaaaagcagtagcactctgtcacaaaaatcaaataccaaagttagtttatatttcagccaacagcggctattcagcttacattaaaagtaaaaggaaggcagagcagataatcaaagcaagcggtctggattatctttttgtaagaccaggtttgatgtatggtgaagagcgacctctctcgattttccaagccaagtgtataaagttatttagtcatttgcctttcttaggtattgttgtacaaaaggtctttccaactaaggttgtgatagtggcagaagcaatcgttactacgcttaggaaaaaaccaacccaaaaaatcctttctattgaagaattaaataataaa

SEQ ID NO: 9730 - protein, 205 aa, Streptococcus agalactiae
MEILIAGGSGFLGKQIIKAALTKGHKVAYLSRHEGKGDIFKDPRLTYIRGDITEADKIHLEDRTFDILIDCIGAIKPNQLDELNVKATQKAVALCHKNQIPKLVYISANSGYSAYIKSKRKAEQIIKASGLDYLFVRPGLMYGEERPLSIFQAKCIKLFSHLPFLGIVVQKVFPTKVVIVAEAIVTTLRKKPTQKILSIEELNNK

SEQ ID NO: 9731 - DNA, 459 bp, Streptococcus agalactiae
gtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 9732 - protein, 153 aa, Streptococcus agalactiae
MLRYAFAPLPNIQPITAIFLITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 9733 - DNA, 990 bp, Streptococcus agalactiae
atggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 9734 - protein, 330 aa, Streptococcus agalactiae; identical to SEQ ID NO: 9498

SEQ ID NO: 9735 - DNA, 177 bp, Streptococcus agalactiae
atgccttttatcaattttcatattgtattatttcctttaatatatcaaaaaattaccattatgcattatatcatctttcgaagtaaagtaaaagggagaatagcaacacgccgtacgcatgaaaactttctcttcatccttttgtgcccggacatcaattttgaaaagattcctttt

SEQ ID NO: 9736 - protein, 59 aa, Streptococcus agalactiae
MPFINFHIVLFPLIYQKITIMHYIIFRSKVKGRIATRRTHENFLFILLCPDINFEKIPF

SEQ ID NO: 9737 - DNA, 1194 bp, Streptococcus agalactiae
atggcaaaagaaaaatacgatcgtagtaaaccacacgttaacattggtacaatcggacacgttgaccacggtaaaactactttaacagcagctatcacaactgtattggcacgtcgcttgcctacttcagttaaccaaccaaaagattacgcttctatcgatgctgctccagaagagcgcgaacgcggaatcacaatcaacactgcacacgttgagtacgaaactgaaaaacgtcactatgcccacatcgacgctccaggacacgcggactacgttaaaaacatgatcactggtgctgctcaaatggacggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactagatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactactttctcaatccgtgaaggtggacgtactgttggttcaggtatcgtttcagaaatcgaagct

SEQ ID NO: 9738 - protein, 398 aa, Streptococcus agalactiae
MAKEKYDRSKPHVNIGTIGHVDHGKTTLTAAITTVLARRLPTSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDEKYEDIIMELMSTVDEYIPEPERDTDKPLLLPVEDVFSITGRGTVASGRIDRGTVRVNDEVEIVGIKEDIQKAVVTGVEMFRKQLDEGLAGDNVGVLLRGVQRDEIERGQVLAKPGSINPHTRFKGEVYILSKEEGGRHTPFFNNYRPQFYFRTTDVTGSIELPAGTEMVMPGDNVTIEVELIHPIAVEQGTTFSIREGGRTVGSGIVSEIEA

SEQ ID NO: 9739 - DNA, 1365 bp, Streptococcus agalactiae
atgaagcttagtttgcatgaagttgctaaagtagttggcgctaaaaatcaagtatcagagtttgaagacgttcccctgggaaatattgaatttgatagtcgtaatatcagtgaaggtgacttatttcttcccttaaaaggagcaagagatggacatgagtttatagagatggcttttgataatggagcaatagcaaccatttcagagaaggaaatagagggtcatccttatcttttagtgtctgatgcacttaaagcatttcaagtcttggcacagtattatattgaaaagatgaacgttgatgttattgcagtaactggctcaaatggtaagacaacaactaaagatatgatagctgcaatcttatcaaccacatataagacttataaaacacaaggaaactacaataacgagattggcttaccctatactgtgctacacatgccagaagatactgaaaaaattattttggagatgggacaggatcatcttggagatatccatgtgttatctgaaattgcaaaaccacgtattgctgttgttactttgattggtgaagcacacttagaattttttggtagtcgagaaaagattgcagaagggaaaatgcaaatcacagatggtatgagttcagatggcatattaattgcaccgggagatccaattattgatccatatcttccagcaaaccagatgactattcgttttggtcatgaccaagaattgcaagtgacagaactcaaagaagaaaaacattccttaacttttaaaactaatgctttggagcaccaattacgtataccagtacctggtaagtacaatgcaactaatgcgatggtcgctgcctatgttggaaaattattagcagtagcagaagaagatatagtggatgctctagaaaatcttcaactaactcgtaatcgcaccgaatggaagaaatcagccaatggagcagatattttatcagatgtttacaatgctaacccaacggctatgcgattgatactagaaaccttttcagctattcccaataatgatggtggaaagaagattgctcttttagctgatatgaaagaactgggagaacaatctgtggatttacataatcaaatgattatgagtatcagacctgactctattgatactttgatttgttatggccaggatattgaggggttggctcaattagcaagccagatgttcccaattggtaaagtgtatttctttaaaaagaatcaagaagtagatcagtttgatcaattgcttgcaaaagtaaaagatactcttaaggagaaagatcaaatattattaaaaggttctaactcaatgaatctttctaaaatagttgatattcttgaagtagga

SEQ ID NO: 9740 - protein, 455 aa, Streptococcus agalactiae
MKLSLHEVAKVVGAKNQVSEFEDVPLGNIEFDSRNISEGDLFLPLKGARDGHEFIEMAFDNGAIATISEKEIEGHPYLLVSDALKAFQVLAQYYIEKMNVDVIAVTGSNGKTTTKDMIAAILSTTYKTYKTQGNYNNEIGLPYTVLHMPEDTEKIILEMGQDHLGDIHVLSEIAKPRIAVVTLIGEAHLEFFGSREKIAEGKMQITDGMSSDGILIAPGDPIIDPYLPANQMTIRFGHDQELQVTELKEEKHSLTFKTNALEHQLRIPVPGKYNATNAMVAAYVGKLLAVAEEDIVDALENLQLTRNRTEWKKSANGADILSDVYNANPTAMRLILETFSAIPNNDGGKKIALLADMKELGEQSVDLHNQMIMSIRPDSIDTLICYGQDIEGLAQLASQMFPIGKVYFFKKNQEVDQFDQLLAKVKDTLKEKDQILLKGSNSMNLSKIVDILEVG

SEQ ID NO: 9741 - DNA, 378 bp, Streptococcus agalactiae
atgggaattttttcgggattaatgggaaatgcttcacaaatggataccgataaagtcgagaatcagttatctgatattctgatttcagatgaacaggttgatttagcttataccttaattcgtgatttgattgtttttactaattatcgtttaattttagtcgataaacagggggtgacaggtaaaaaggtttcttataattctataccttatgcttctatatcacgttttacagtggaaactagtggtcattttgatttagatgctgagttaaagatttggatatcatcagcaatagaaccagcagaagtacttcagtttaagaacgaccgtaacatagtgagtatacagaaagctttggcgacagctgttttaaaa

SEQ ID NO: 9742 - protein, 126 aa, Streptococcus agalactiae
MGIFSGLMGNASQMDTDKVENQLSDILISDEQVDLAYTLIRDLIVFTNYRLILVDKQGVTGKKVSYNSIPYASISRFTVETSGHFDLDAELKIWISSAIEPAEVLQFKNDRNIVSIQKALATAVLK

SEQ ID NO: 9743 - DNA, 942 bp, Streptococcus agalactiae
atgaaagagaagctatttcaggtaattggattcaataaagacgatttagcctattcttattttgatttaagtgaagaagactatcaaaatgcggaattagacttagaaagtttaccttttttatcagactacaaggttgttatttttgatcagtttcaagatattacaactgataaaaaaacttatttagatgaacaagcaatgaagcgctttgaagcctacttgcagaatcctgtagatactacgagacttgttatttgtgctccaggaaaacttgatggaaaacgtcgacttgtaaagttattgaaacgtgatgctcgtgttttagaggctaatactttaaaagaatcagatttaaagacgtattttcaaaaatatgctcaccaagaaggattagtttttgaagcaggtgtttttgatgagttattgattaagtctaactatgattttagtgatactttaacgaatatcgctttcttaaagtcatataaaacagacggtcatatttcgtccaatgatgttagagaggctatccctaaaagcctgcaagataatatatttgatttgactcaagatgtcttacttggcaggatagatttagcgcgtgatttagtaagagatttacgtctacaaggcgaagacgaaatcaaattgattgcaatcatgttaggacagtttcggatgtttttgcaagttaaaatattggctagtaaagggaagtcagagagtcaaattgtttctgaactatcccattacataggacgtaaaatcaacccttatcaagtaaaatttgctgtcagagattctagaaaccttccccttgcttttttaaaagaagcgattaggattttaatcgagactgactatgctattaaaagagggacttatgataaggattatctctttgatttagccttattaaaaattgctcataaaaagccc

SEQ ID NO: 9744 - protein, 314 aa, Streptococcus agalactiae
MKEKLFQVIGFNKDDLAYSYFDLSEEDYQNAELDLESLPFLSDYKVVIFDQFQDITTDKKTYLDEQAMKRFEAYLQNPVDTTRLVICAPGKLDGKRRLVKLLKRDARVLEANTLKESDLKTYFQKYAHQEGLVFEAGVFDELLIKSNYDFSDTLTNIAFLKSYKTDGHISSNDVREAIPKSLQDNIFDLTQDVLLGRIDLARDLVRDLRLQGEDEIKLIAIMLGQFRMFLQVKILASKGKSESQIVSELSHYIGRKINPYQVKFAVRDSRNLPLAFLKEAIRILIETDYAIKRGTYDKDYLFDLALLKIAHKKP

SEQ ID NO: 9745 - DNA, 954 bp, Streptococcus agalactiae
atgggacttttagtagatggcaaatgggttgatcaatggtatgatactgcatcaactggtggtaaattcgtccgaaccgttacacaattccgtcattgggttactaaagatggttcagcagggcctagtggggatgcaggttttaaagcagaatctggacgatatcatctctacgtttcactagcttgcccttgggcatcacgtgtattaatcatgagaaagcttaaaaatctagaatctcatatctctatctccattgttaaccctttaatgttggagaatggttggacttttcaagaatataaaggcgttattcctgatatgattaaccaaagccaatacctttaccaaatctatcaagcaagtcaaagtgattatacaggacgcgtgacagtccctgttctttgggataaaaaattccatacaatcgttaacaatgaatcatctgaaattatgcgtatgttaaatactgcatttaatcatattactggaaatactgacgattactatcccgattccttacaaggacaaattgacgaaatgaataattttatttatccaaaaataaataatggtgtctataaagctggttttgccacttctcagaacgtttatcaaaaggaagttgaaaccttattcacagctttagatcagttagaaaaacacttatctgataaccattatcttgttggagaacaatttaccgaagctgatattcgccttttcacaactttagttcgctttgacaccgtttattatggtcattttaaatgtaatttaaaagcgctacatgattacccacatttatggcattatacaaaacgtatttacaacctacctggaattgctgagacagttaattttgatcatatcaaaaaacactattacggtagccataaaaccattaaccctactggtattattccagctggacctaacttagactggacaatt

SEQ ID NO: 9746 - protein, 318 aa, Streptococcus agalactiae
MGLLVDGKWVDQWYDTASTGGKFVRTVTQFRHWVTKDGSAGPSGDAGFKAESGRYHLYVSLACPWASRVLIMRKLKNLESHISISIVNPLMLENGWTFQEYKGVIPDMINQSQYLYQIYQASQSDYTGRVTVPVLWDKKFHTIVNNESSEIMRMLNTAFNHITGNTDDYYPDSLQGQIDEMNNFIYPKINNGVYKAGFATSQNVYQKEVETLFTALDQLEKHLSDNHYLVGEQFTEADIRLFTTLVRFDTVYYGHFKCNLKALHDYPHLWHYTKRIYNLPGIAETVNFDHIKKHYYGSHKTINPTGIIPAGPNLDWTI

SEQ ID NO: 9747 - DNA, 483 bp, Streptococcus agalactiae
atggctacttttcaaattaaagaaaaaatgttttctctaggcggtaaatttactattacagacctgactgggcttccctgttatcacgttgaaggaagtttgttccctctacctaagacttttaaagtctttgacgaagaggaacatctcattagtcagattgagaagaaggttttaagttttttaccaaagtttaatgtgacattagccaatgggaatcatttcacgattaagaaagatttctcatttttgaaacctcattacaccattgaagaccttgatatggaagttaagggaaatttttgggatatggatttccaactcttaaaagacaatcaagttatagcaaacatatctcaacagtggtttcgtatgacttcaacttatcaggtagaagtttacagtgaaacttacaacgatttgacaatttcgcttgtcatagcgatcgactatgtcaaagagttagaaaaaaatgcatcaaac

SEQ ID NO: 9748 - protein, 161 aa, Streptococcus agalactiae
MATFQIKEKMFSLGGKFTITDLTGLPCYHVEGSLFPLPKTFKVFDEEEHLISQIEKKVLSFLPKFNVTLANGNHFTIKKDFSFLKPHYTIEDLDMEVKGNFWDMDFQLLKDNQVIANISQQWFRMTSTYQVEVYSETYNDLTISLVIAIDYVKELEKNASN

SEQ ID NO: 9749 - DNA, 756 bp, Streptococcus agalactiae
atgaaaaattttataaaacaaagtgatactacatttgttcgaattatcaaaagtcttttaattggtggttttataggggccatacttggttccgtaggagctctttttatcatatttggtcaagataagtacttatctgaaattaatattgttcaatatttcctatgggttagtcgtattgttgtaattataacagctctctttagtctcatctacctctatcagattcaaaaatatcagaaagtttttttcaatgttgatgaaagtcaatctgaagaaatttatcgccagattaatttaagacattcttatgggatgacttttgtgtcaatttcaatagtactcagtatagttaatactttatttaactataaactaaatatttttgatgattcagttactttagttattccaatatatgatttatcactgctatttgttttattgggtttacatatatattttttaaaggtatatcggaatatccgaggtataaaaatgacagtcgctccaactttaaaagagttgaaaaacaatgtcttacaattggacgaagcagagttggaatcaaattataagatgtgttttgatattgtcatgaatttaagtggttttattttccctacgatctattttgtattattctttatctcatttgtttttcaaaaagtggagattgtagcaattattataacaacatctattcatatctacattctcattaagtctttaaaagcagcacgtcatttttataga

SEQ ID NO: 9750 - protein, 252 aa, Streptococcus agalactiae
MKNFIKQSDTTFVRIIKSLLIGGFIGAILGSVGALFIIFGQDKYLSEINIVQYFLWVSRIVVIITALFSLIYLYQIQKYQKVFFNVDESQSEEIYRQINLRHSYGMTFVSISIVLSIVNTLFNYKLNIFDDSVTLVIPIYDLSLLFVLLGLHIYFLKVYRNIRGIKMTVAPTLKELKNNVLQLDEAELESNYKMCFDIVMNLSGFIFPTIYFVLFFISFVFQKVEIVAIIITTSIHIYILIKSLKAARHFYR

SEQ ID NO: 9751 - DNA, 561 bp, Streptococcus agalactiae
atgtcaaaaaataacaacactacctgtcttattgaaactgctatttttgcagcgcttgctatggctttatcaatgattcctgattttgcgtcatggttcactccctcttttggagcaattcctctgatactttttgcattacgtcgtggtacaaaatacggtctatttgctggcttaatttggggcttattgcactttgttctttccaaagtatattaccttagtttatcccaagtttttatagaatacatcttagcatttataagtatgggacttgcaggcgtattttctgctaaatttaaagatgcacttagcagcagctctaaaactaaagctttatcattagcattatctggagcaatattagcaacacttgttcgttatgtttggcattatatcgctggtgttattttttgggctagttatgcaccaaaaggtatgtctgctacattatactcattaagcgtcaatggtactgctggtttgttaactctattttttgtagtcattagtattattattttagttatcagctaccctagcttctttttacctaagaaa

SEQ ID NO: 9752 - protein, 187 aa, Streptococcus agalactiae
MSKNNNTTCLIETAIFAALAMALSMIPDFASWFTPSFGAIPLILFALRRGTKYGLFAGLIWGLLHFVLSKVYYLSLSQVFIEYILAFISMGLAGVFSAKFKDALSSSSKTKALSLALSGAILATLVRYVWHYIAGVIFWASYAPKGMSATLYSLSVNGTAGLLTLFFVVISIIILVISYPSFFLPKK

SEQ ID NO: 9753 - DNA, 957 bp, Streptococcus agalactiae
atgacaacttactacgaagctataaactggaacgaaattgaagatgttattgataaatcaacttgggaaaaactaaccgaacaattttggctcgatacacgtatccctttatcaaatgacttagacgattggcgcaaactttctgctcaagaaaaagatcttgttggcaaggtttttggaggcttaaccctacttgataccatgcaatcagaaactggtgttgaagctattcgtgccgatgttcgcacgcctcacgaagaagctgtcttaaacaatattcaattcatggaatctgttcacgctaaatcttattcttcaattttctcaactttaaatactaaatcagaaattgaagaaattttcgagtggactaataataatgagttccttcaagaaaaagcacgtattatcaatgacatttatgctaatggaaatgcccttcaaaaaaaggtggcttccacctacctcgaaactttccttttttattctggctttttcacacctctttactatttgggaaataataagttagcaaatgttgctgaaatcattaaattaattattcgtgatgaatctgtacatggtacttatatcggttacaaattccagcttggttttaacgaattaccagaagatgagcaagagaattttcgtgattggatgtatgacctcctttatcagctgtatgaaaacgaagaaaaatacaccaagacactttatgatggcgtaggatggactgaagaagttatgacctttttacgctacaatgctaataaagctcttatgaatttaggacaagatcctttattcccagatacagcaaatgatgtcaacccaattgttatgaatggtatttcaacaggaacatcaaaccatgacttcttctctcaagtaggtaatggttacctacttggtagcgttgaagctatgcatgatgatgactataactatggatta

SEQ ID NO: 9754 - protein, 319 aa, Streptococcus agalactiae
MTTYYEAINWNEIEDVIDKSTWEKLTEQFWLDTRIPLSNDLDDWRKLSAQEKDLVGKVFGGLTLLDTMQSETGVEAIRADVRTPHEEAVLNNIQFMESVHAKSYSSIFSTLNTKSEIEEIFEWTNNNEFLQEKARIINDIYANGNALQKKVASTYLETFLFYSGFFTPLYYLGNNKLANVAEIIKLIIRDESVHGTYIGYKFQLGFNELPEDEQENFRDWMYDLLYQLYENEEKYTKTLYDGVGWTEEVMTFLRYNANKALMNLGQDPLFPDTANDVNPIVMNGISTGTSNHDFFSQVGNGYLLGSVEAMHDDDYNYGL

SEQ ID NO: 9755 - DNA, 867 bp, Streptococcus agalactiae
atggcaaatcaacttaatatttcccgcacagctatttggaaaggtataaaaacgttagaagaattaggcctagagattgagtctgtcactaacaagggctaccgattggtatcaggtgacatattattaccagaacaactcgaacaagaaattggtattaaggttagtcttaataataatagtgcttcaacccaactagatgctaaaatggggatagaaagtaaattaaagactccacacctttttttagctcctaatcaaaaaaaagctaaaggacgttttgatagacctttctttacatcaaatcaaggcggcatctatatgtctcttttattacaacctaatgtaccgattgaagatataaaaccttatactgtcatggtagcctctagtgctgtaaaagctatctcacggttaacaggaattactcctgaaattaagtgggtcaatgatatttatttagataataaaaaaatagctggtattttaaccgaggctatcgcttctgttgagagtgggttggtaacgaatgttattataggattaggtatcaatttctatatcaaagagttccctagggcgttaactaagcgcgcaggtagtctctttacagagcaaccgaccataactagaaatcaattgattacagaaatctggaatctctttttcaatattccactagaggatcacttaaaggtatatagagaaaaatccctagtcttagatagaaccgttagctttatggatggtcaaacaatgtattctgggaaagctattgatattacagataaaggatatttagtggttgagttagatgatggtcagttgaaaacacttcgcagtggcgaaatcagtctttcttcttgg

SEQ ID NO: 9756 - protein, 289 aa, Streptococcus agalactiae
MANQLNISRTAIWKGIKTLEELGLEIESVTNKGYRLVSGDILLPEQLEQEIGIKVSLNNNSASTQLDAKMGIESKLKTPHLFLAPNQKKAKGRFDRPFFTSNQGGIYMSLLLQPNVPIEDIKPYTVMVASSAVKAISRLTGITPEIKWVNDIYLDNKKIAGILTEAIASVESGLVTNVIIGLGINFYIKEFPRALTKRAGSLFTEQPTITRNQLITEIWNLFFNIPLEDHLKVYREKSLVLDRTVSFMDGQTMYSGKAIDITDKGYLVVELDDGQLKTLRSGEISLSSW

SEQ ID NO: 9757 - DNA, 564 bp, Streptococcus agalactiae
atgactaatcataaaacaaaaaaattaacggttttagcaattatgattgctttagatgtttttttaacgcccatttttagaatagaaggcatggcctttatgtctagtgtggttaatattatcgctggagttataatgggaccaatctatgcattagttatggcacttgtaacggcttttattcgtattttaactcaagcaggagtagcatctgttgcacctttagctattctaggagctggtccaggagctttcttagcgggttggttttatcggttttatgcgaaagactggatgtcttgggtgggtgagtttataggaacagggataattggagcacttttatcagctccaattatggtctggttttggacttggacagcggatggaaatcacgaagtgttagctaaagcatctgcagctcaatccatttttctttttatgccaaggtttataggggcgactataattggcggtgttattgctttgttgctacttcagggattaaagcgggttcctgtatttatgacaatacaagcattatttaaaggagaaaaagtaaaa

SEQ ID NO: 9758 - protein, 188 aa, Streptococcus agalactiae
MTNHKTKKLTVLAIMIALDVFLTPIFRIEGMAFMSSVVNIIAGVIMGPIYALVMALVTAFIRILTQAGVASVAPLAILGAGPGAFLAGWFYRFYAKDWMSWVGEFIGTGIIGALLSAPIMVWFWTWTADGNHEVLAKASAAQSIFLFMPRFIGATIIGGVIALLLLQGLKRVPVFMTIQALFKGEKVK

SEQ ID NO: 9759 - DNA, 1281 bp, Streptococcus agalactiae
atgagtaaacatcaagaaattttggagtacctagaaaatttagctgttggtaagagggttagtgtacgcagtatttcaaatcatttaaaggtgagtgatggcactgcataccgcgctataaaagaggcagaaaataggggtattgttgagactagaccgcgtagtgggacagtacgtgttgctcaaaaagcaaaggttaatattgaaaaactgacttatgctgaaattgcaaggattagtgactcacaagttgttgcaggaatagagggactcagcaaggagtttagtaaattttctataggtgcaatgactcacagaaatattgaaaaatatttggtgcaaggagggttattgattgttggcgaccgtgatgagatacaacatttagccttacaacatcaaaacgctatcttagttacaggtggctttaatgtttccccatctgtttgtcgtttagcagataaacttcaaattcccgtaatggtaacacactatgatacattcacagtatcaacgatgattaatcacactttgtcaaatgccaaaattcgtactgatttaaagaccgttgaacaagtctatcagtcgcaaatggattacggtttcttagcgcaggatgataccgtaaaagaatttaatcttcttgttaaacaaactaaaaatgttcgttttccaatagtcaaccaagctaatgttgtcgttggtgttgttagtgttcaagatattcttggaaaagataaagaagtaaaattggcaacagtcatgtcaaaaaatatcattgttgctaaacctcgaatgagtctagctaatatcagtcaaaaaatgatttttgaagatttgaatatgatgccagtagtatcggatgactttgaattattaggcgttattacaagacgacaagctgtagaaaatttatcgatgtcgcaagggacggatttatacacctatagtgatcaaatcttgtctaatttacaaattgaagatggtcacttttcgtttttagtagaacccgctatgattgaccatacaggtagcttaacacaaggagttttgacggagttcttaaaagaaatttgtattcgtgtcttaactcgtaagcatcaacgcagtattgttgttaaacaaatgacactttatttcttgcaacctgttcaaattgatgaaataataatggtaacgccaacaattatttcagaaaaacggcgcgaagctacactcgatttagaattaaaattagaaaataaaattattgctaaagctatgatagcggtaaaaattaat

SEQ ID NO: 9760 - protein, 427 aa, Streptococcus agalactiae
MSKHQEILEYLENLAVGKRVSVRSISNHLKVSDGTAYRAIKEAENRGIVETRPRSGTVRVAQKAKVNIEKLTYAEIARISDSQVVAGIEGLSKEFSKFSIGAMTHRNIEKYLVQGGLLIVGDRDEIQHLALQHQNAILVTGGFNVSPSVCRLADKLQIPVMVTHYDTFTVSTMINHTLSNAKIRTDLKTVEQVYQSQMDYGFLAQDDTVKEFNLLVKQTKNVRFPIVNQANVVVGVVSVQDILGKDKEVKLATVMSKNIIVAKPRMSLANISQKMIFEDLNMMPVVSDDFELLGVITRRQAVENLSMSQGTDLYTYSDQILSNLQIEDGHFSFLVEPAMIDHTGSLTQGVLTEFLKEICIRVLTRKHQRSIVVKQMTLYFLQPVQIDEIIMVTPTIISEKRREATLDLELKLENKIIAKAMIAVKIN

SEQ ID NO: 9761 - DNA, 750 bp, Streptococcus agalactiae
atgtgggaagttgaagaatacgttcgtagacgttgtaaagaagaaaacgtattgccattgcaaatcggggttgatggtgcagttatggattacccatatgctacttgttgtgggcttaatgatgaagtggctcatgcctttcctcgtcattataccctaaaacaaggtgaccttttaaaagtagatatggttttaagcgaacctttagataaatcaattgttgacgtttcatcgttaaactttgacaacgtggctcaaatgaaaaagtacacggaaacatatagtggtggtttggcagactcgtgttgggcttatgctgtaggtgaagtttcacaagaggtgaaagacttaatgtctgtgacaagagaagcaatgtatattgggattgaaaaagcagttatcggaaaccgcattggtgatattggagctgctattcaggattatgcagagagtcgtggttatggagttgttcgtgatttggttggtcacggtgttggtccaacaatgcatgaagagcctatggtgcctaactatggtacagcaggtcgaggtctccgtcttcgtgaggggatggttttaaccatcgaaccaatgattaatactggtacttgggaaattgatacagacatgaaaactggttgggcacataaaaccttagatggtggtctttcttgtcaatatgaacatcaatttgttatcactaaagatggtcctgttattttaacgagtcaaggagaagaaagaacttac

SEQ ID NO: 9762 - protein, 250 aa, Streptococcus agalactiae
MWEVEEYVRRRCKEENVLPLQIGVDGAVMDYPYATCCGLNDEVAHAFPRHYTLKQGDLLKVDMVLSEPLDKSIVDVSSLNFDNVAQMKKYTETYSGGLADSCWAYAVGEVSQEVKDLMSVTREAMYIGIEKAVIGNRIGDIGAAIQDYAESRGYGVVRDLVGHGVGPTMHEEPMVPNYGTAGRGLRLREGMVLTIEPMINTGTWEIDTDMKTGWAHKTLDGGLSCQYEHQFVITKDGPVILTSQGEERTY

SEQ ID NO: 9763 - DNA, 1944 bp, Streptococcus agalactiae
atgaatgaattagtatctttgttgaatcagtacgcaaaagagtattatacacaagataatcccacagtttctgacagtcaatatgaccagttatatcgagagttagtagaattagaaaagcaacatccagaaaacattttgccaaatagtcccacacatcgagtgggtggtttagttttagaaggctttgaaaaataccaacatgaatatcctttgtattcattgcaggatgctttctcaaaagaagaattgatagcctttgataaacgtgttaaagcagagtttccaactgctgcttatatggcagagctgaaaattgatggtctatctgtctcgttgacttatgtaaatggtgttttacaggttggggcaacacgtggtgatggcaatattggagaaaatattactgaaaatttaaagcgtgttcatgatattcctctacatttagaccaaagtttagatattactgttcgcggagagtgctaccttcccaaagaatcttttgaagctattaacatagaaaaacgagcaaatggtgagcaggaatttgctaatcctaggaatgcagcagcaggaaccttgcgccaattaaacacaggaattgttgcgaaacgtaaattagcaacttttctttatcaagaagctagccctacgcaaaaagaaacacaagatgatgttttaaaagagctagaaagctatggcttttcagtcaatcatcatcgtttaattagctcgtctatggagaaaatttgggattttatccaaactatagaaaaagatagagtttccctcccttatgatatcgatggtattgttattaaggttaatagcatagcaatgcaagaagagctgggcttcactgtaaaggcacctcgttgggcgattgcatataaatttcctgctgaagaaaaggaagcagaaatattatctgttgattggacagttgggcgaacaggagtcgtaacaccaacagctaacctaactccagttcaactagcagggacaaccgttagtagggccactctgcataatgtagattatattgccgaaaaagatatccgtattggagatactgttgttgtatacaaagcaggggatatcatccctgcagtcttaaatgtcgttatgagtaagcgaaaccagcaagaagtcatgcttattcctaaactatgtccttcttgtggtagtgaattagttcattttgaaggtgaggtggctttacgttgtattaatccgctgtgccccaaccaaatcaaagaacgtttagctcattttgctagccgagatgctatgaatattacaggttttggtccatccttagtcgaaaaattatttgatgctcatttaatagcagatgttgcagatatttatcgtttaagtatagagaatttattaactttagatggtattaaagagaaatctgcaactaagatttatcatgcaatccaatcttcaaaagaaaattctgctgaaaaacttctttttggcctaggtattcgtcatgtgggaagcaaggcgagccgccttttattggaggaatttggtaatttgaggcaactaagtcaagcaagtcaagaaagtattgcctcaattgatggactaggaggggttattgccaaatcacttcataccttctttgaaaaagaagaggtagataaactactagaggaattaacttcctataacgttaattttaattatctaggaaaacgagttagtacagatgcacaactttcaggtttaacagtcgttttaaccggtaagcttgaaaaaatgactcgtaatgaagcaaaagagaaattacaaaaccttggtgctaaggtgacaggtagcgtttctaaaaagactgatttaattgttgcaggaagcgatgcaggaagtaaactaaccaaggctcaagatttagggattacaatacaagatgaagactggttactcaacctt

SEQ ID NO: 9764 - protein, 648 aa, Streptococcus agalactiae
MNELVSLLNQYAKEYYTQDNPTVSDSQYDQLYRELVELEKQHPENILPNSPTHRVGGLVLEGFEKYQHEYPLYSLQDAFSKEELIAFDKRVKAEFPTAAYMAELKIDGLSVSLTYVNGVLQVGATRGDGNIGENITENLKRVHDIPLHLDQSLDITVRGECYLPKESFEAINIEKRANGEQEFANPRNAAAGTLRQLNTGIVAKRKLATFLYQEASPTQKETQDDVLKELESYGFSVNHHRLISSSMEKIWDFIQTIEKDRVSLPYDIDGIVIKVNSIAMQEELGFTVKAPRWAIAYKFPAEEKEAEILSVDWTVGRTGVVTPTANLTPVQLAGTTVSRATLHNVDYIAEKDIRIGDTVVVYKAGDIIPAVLNVVMSKRNQQEVMLIPKLCPSCGSELVHFEGEVALRCINPLCPNQIKERLAHFASRDAMNITGFGPSLVEKLFDAHLIADVADIYRLSIENLLTLDGIKEKSATKIYHAIQSSKENSAEKLLFGLGIRHVGSKASRLLLEEFGNLRQLSQASQESIASIDGLGGVIAKSLHTFFEKEEVDKLLEELTSYNVNFNYLGKRVSTDAQLSGLTVVLTGKLEKMTRNEAKEKLQNLGAKVTGSVSKKTDLIVAGSDAGSKLTKAQDLGITIQDEDWLLNL

SEQ ID NO: 9765 - DNA, 1137 bp, Streptococcus agalactiae
atgaaaaatgaaatgttagcactcattctcgccggaggacaaggcactcgactcggaaaattgactcagagcattgcgaaacctgctgttcaatttggaggtcgttaccgtattattgactttgcgctttcaaattgtgcgaattcaggtattaataatgttggagttattactcagtatcaaccgctggaactcaatactcatattggaaacggatctagctggggactagatggtatcgattcgggagtaactgtattacagccatattctgcaacagaaggtaatcgctggtttcaaggtaccagccacgctatctatcaaaatattgactacattgatcgtattaatccagaatatgtactcattctctctggggaccacatctataaaatgaactatgatgacatgctacagacgcataaagataatttagcaagcctaacagtcgctgttttagatgttcctttaaaagaagcaagccgttttggaattatgaatactgattcaaacgaccgtattgtcgaatttgaagaaaaacctgaacatcctaagtcaacaaaggcttcaatgggaatatacatttttgactggaagagattacggacagttttaattgatggtgaaaagaacggcatagacatgtcagactttggtaaaaatgttataccagcataccttgaatcgggtgaacgtgtttatacctataattttgatgggtattggaaagatgttggtactattgaatccctttgggaagctaatatggaatatattggagaagataacaaattacatagtcgtgatcgttcatggaaaatctattctaaaaatttgattgcaccacctaatttcatgacagaagatgcaaatgttaaagattctttagttgtagatggatgctttgttgcaggaaatgttgagcactccattttatcaactaatgtccaggtaaaaccaaatgctattattaaagactcctttgttatgagtggcgcgactatcggtgaaggtgcaaagataaatcgagctattatcggtgaggatgctgttattggtgatggtgttgtgattgatggaagtaaagaagtagaagttattggttataaagaagtagcgggggttccaaatgaagat

SEQ ID NO: 9766 - protein, 379 aa, Streptococcus agalactiae
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 9767 - DNA, 1269 bp, Streptococcus agalactiae
atggataaaattattgtggaaggtgggcaaacgcagcttcaaggtcaagttgttattgaaggagctaaaaatgcagttttacctcttttagcagccacaattttaccaagccaagggaaaacattgttgaccaatgttcctatcttgtctgatgtatttacaatgaacaatgttgttcgtggtttagatattcaagttgactttaattgcgataaaaaagaaatcttagtggatgcctcaggtgatattttagatgttgcaccttatgaatttgttagtcaaatgagagcttctattgttgttttgggacctattttagctagaaatggccatgctaaggtttcaatgccaggcggttgtacaattggtagccgaccaattgaccttcatcttaaaggtttagaagctatgggagctacgattacacaaaatggtggtgatattactgcccaagctgaaaagcttaagggagctaatatatacatggattttccctcagtcggtgccactcaaaacttaatgatggctgctacacttgcttcaggcacaacaacgatagagaatgctgcacgtgaaccagaaattgtagaccttgcgcagttactaaataaaatgggagctaaagtaaagggtgctggtacggaaacattaacgatcattggtgttgatgctttacatggtacagaacatgatgttgtccaagatcgtattgaagctggaacctttatggtggcagctgctatgacttctggaaatgttctagtaaaggatgctatttgggaacataaccgtcctttaatctctaaattgatggagatgggtgttgaagtgtcagaggaagaagatggtattcgtgtaaaagctgatactaaaaaattgaagccagtgactgtgaaaacactccctcatccaggatttcctactgatatgcaagctcaatttacagctctaatggcagtagttaatggcgaatcaactatgattgagacagtttttgaaaatcgttttcaacatttggaagaaatgcgtcgcatgggattacaaacggaaattttacgagatactgcaatgattcatggtgggagagctttacaaggtgcaccggtcatgtctactgacttacgagctagtgcagctttaatcttggcaggaatggttgcgcaagggcaaacagtagttggccaattaacccatttagaccgtggttattatcaattccatgaaaaattagcggctcttggtgctaatattaaacgtgtaagtgaggcg

SEQ ID NO: 9768 - protein, 423 aa, Streptococcus agalactiae
MDKIIVEGGQTQLQGQVVIEGAKNAVLPLLAATILPSQGKTLLTNVPILSDVFTMNNVVRGLDIQVDFNCDKKEILVDASGDILDVAPYEFVSQMRASIVVLGPILARNGHAKVSMPGGCTIGSRPIDLHLKGLEAMGATITQNGGDITAQAEKLKGANIYMDFPSVGATQNLMMAATLASGTTTIENAAREPEIVDLAQLLNKMGAKVKGAGTETLTIIGVDALHGTEHDVVQDRIEAGTFMVAAAMTSGNVLVKDAIWEHNRPLISKLMEMGVEVSEEEDGIRVKADTKKLKPVTVKTLPHPGFPTDMQAQFTALMAVVNGESTMIETVFENRFQHLEEMRRMGLQTEILRDTAMIHGGRALQGAPVMSTDLRASAALILAGMVAQGQTVVGQLTHLDRGYYQFHEKLAALGANIKRVSEA

SEQ ID NO: 9769 - DNA, 519 bp, Streptococcus agalactiae
atgtctcaaattacttttaaaaaggttggccttgataatgtgaatattttacagaatattgctatagaaacctttcggcagacgttttctcatgataatagtgaggaacaacttcaagcatttttcaatgagtcttacactttaccagtattaaaatcggaaattacccatgctgaatctgatacttattttgtttatcttgatacagatttagtgggttatttaaaagtaaactggggaagtcagcaaactgaaaaagatcttgataaagcatttgaaattcaaaggatttatcttctagatgcctaccaagggcaaggtataggtaaggctactttcgaatttgctttggatttagcttataaatcaggcttagattgggcttggttaggtgtttgggagtttaatcataaagctcaggcattttacgctaaatacggatttgaaaaattttctgagcaccaattttcagtaggtgataaagtggatacggattggttattaagaaaaagtttacac

SEQ ID NO: 9770 - protein, 173 aa, Streptococcus agalactiae
MSQITFKKVGLDNVNILQNIAIETFRQTFSHDNSEEQLQAFFNESYTLPVLKSEITHAESDTYFVYLDTDLVGYLKVNWGSQQTEKDLDKAFEIQRIYLLDAYQGQGIGKATFEFALDLAYKSGLDWAWLGVWEFNHKAQAFYAKYGFEKFSEHQFSVGDKVDTDWLLRKSLH

SEQ ID NO: 9771 - DNA, 3621 bp, Streptococcus agalactiae
atgacctttaagcctttcttaaatccagaagatattgctgttattcagacagaagaaaaaaattctgataaaaaacaaaagcgaacgcctgaacaaattgaagccatttatacttttggtaacaatgtcctggtatcagcttcggctggttctggaaagacttttgtaatggttgagcggattttagataaacttttaagaggggttccgattgactctttgtttatctcaacatttacagtaaaagcggcaggtgagctcaaagaacgtttagaaaagaaaataaacgagtctttgaaatccgcagaatcagatgatttaaaacagtttctcacccagcaacttgtcggcattcaaacagctgatattggtactatggatgcttttacgcaaaaaatagttaaccaatatggttatactttgggcatatcacctatatttaggattttacaagataaaaatgagcaagacgtcataaagaatgaggtctatgctgatttattttctgactacatgactgggaagaatgcagcttcattcataaaattagtcaaaaatttctcaggtaatcgtaaagatagcaaagcttttcgagaaatggtttataaagtttatgcttttagccagtccaccgataaccccaagcgctggatgcaaacagtttttctaaaaggtgcacaaacttacactgattttgaagctattccagatcaagaagtttcaagccttttaaatgtaatgcaaacaactgctaatcaattacgtgatttaacggatcaagaagattataagcaattaactgctaaaggggttccgacagcaaattacaaaaaacaccttaaaataattgaaaatttagtccattggtctcaagactttaatttgctgtatggaaaaaaaggattgactaatttggcacgtgatatcactaatgtgattccttcaggcaatgatgttacagttgctggcgttaaatatcctatctttaaacaattgcataatcgtatcgttggacttaagcacttagaagttatttttaagtatcaaggagaatctcttttcttgttagaattattgcaatcctttgttttagatttctcagaacaatatttacaggagaagattcaagaaaatgcttttgaattttctgatattgcccattttgcaattcaaatattggaagaaaatcatgatattaggcaactttatcaagataagtatcatgaagtaatggttgatgagtatcaggacaataaccatacccaagagagaatgttagaattattgtctaatggacataatcgtttcatggttggagacataaaacaatcaatttaccgttttcgtcaggctgatccacaaatttttaatgataaatacaaagcttaccaagacaatccaagtcaagggaaattaattattctgaaagagaattttcggagtcaatcagaggttttagacagtacaaatagtgtgtttacacatcttatggatgaagaagtaggagacattctttatgatgaaagtcaccaattaaaagctggtagtccaagacagcaagaaagacatccgaataataaaacacaagttttactattagatactgatgaagatgatatagatgacagtgatagtcaacaatatgatattagcccagctgaagcaaagttagtcgcaaaagaaattattcgattgcataaagaagagaatgttccctttcaagatatcaccctcttagtttcttcaaggacaaggaatgatggtatcttacaaacttttgaccgttatggtattcctttggtaactgacggtggggagcaaaattacttaaaatcagtcgaagtgatggtaatgcttgatactttgcggtcaattgataatcccttaaatgattatgctctagttgctcttttgagatctcccatgtttggctttaatgaagatgatttaacaagaattgctattcaggatgtcaaaatggctttttatcataaagtgaaattgtcttatcataaagaaggtcatcatagtgatttaattactccagaattatcttctaaaatagatcactttatgaaaacattccagacttggcgtgattttgctaaatggcattcgctttatgatttaatatggaaaatatataatgaccgtttttattatgattatgtaggagctctgcctaaagctgagcaacgtcaagccaatctatatgccttggcacttcgagcaaatcagtttgaaaaaacaggtttcaagggtttatcacgctttattcgaatgattgataaagttttagaaaatgaaaatgatttggcagatgttgaggtggcattaccgcaaaatgctgttaacctaatgactatacacaaatcaaaggggcttgagtttaagtatgtatttattttaaatattgataagaaattttcaatggtagacataacttcccctcttattttaagccgaaatcaaggaattggtattaaatatgttgctgatatgcgacatgaactcgaagaagagatactgcctgcagtaaaggttagcatggaaacacttccttaccaacttaataaaagagagttacgcttagctactttatcagagcaaatgcgtttactttacgtagctatgacacgtgcagagaaaaaattatatctggttggtaaggctagtcaaaccaaatgggctgatcattatgacttagtatctgaaaataatcatctcccattagctagtcgtgagacttttgtgacctttcaagattggttactggctgttcatgaaacctataagaaacaagagttgttttatgacatcaacttcgtatcattagaggaattaacagatcaccacatagggatggttaaccctagtctacctttcaatcccgataataaggtagagaatcgtcagtctgaagatatcgtgcgtgcgattagcgtgttagaatctgttgagcagattaatcaaacttataaagcggctattgagttaccgacagtgagaacaccaagtcaagtcaaaaaaatctatgagcctattctagatatagaaggtgttgatgtgatggaaactattactaaaacatcagtagattttaagttacctgatttttctacaagtaaaaagcaagacccagcagctttaggatctgctgtacatgaattaatgcaacgcatagagatgtcatctcatgtcaaaatggaagatattcaaaaagctttgacagaagtgaatgctgaaacaagtgtcaaagcggctattcagattgaaaaaatcaactattttttccaagaaacctcactcggtaagtatatacaagaagaagtagaacatctgcatcgagaggcaccttttgccatgttaaaagaagatccggagagtggtgagaaattcgttgtacgtggtattattgatgggtatctactattagaaaatcggataattctatttgattataagactgataaatttgtcaatcctctagaattaaaagaacgctatcagggacaaatggctttatatgcagaagctttaaaaaaatcttacgagatagaaaagatagacaaatacttaattcttttaggtggtaaacagctagaagtggtaaaaatggat

SEQ ID NO: 9772 - protein, 1207 aa, Streptococcus agalactiae
MTFKPFLNPEDIAVIQTEEKNSDKKQKRTPEQIEAIYTFGNNVLVSASAGSGKTFVMVERILDKLLRGVPIDSLFISTFTVKAAGELKERLEKKINESLKSAESDDLKQFLTQQLVGIQTADIGTMDAFTQKIVNQYGYTLGISPIFRILQDKNEQDVIKNEVYADLFSDYMTGKNAASFIKLVKNFSGNRKDSKAFREMVYKVYAFSQSTDNPKRWMQTVFLKGAQTYTDFEAIPDQEVSSLLNVMQTTANQLRDLTDQEDYKQLTAKGVPTANYKKHLKIIENLVHWSQDFNLLYGKKGLTNLARDITNVIPSGNDVTVAGVKYPIFKQLHNRIVGLKHLEVIFKYQGESLFLLELLQSFVLDFSEQYLQEKIQENAFEFSDIAHFAIQILEENHDIRQLYQDKYHEVMVDEYQDNNHTQERMLELLSNGHNRFMVGDIKQSIYRFRQADPQIFNDKYKAYQDNPSQGKLIILKENFRSQSEVLDSTNSVFTHLMDEEVGDILYDESHQLKAGSPRQQERHPNNKTQVLLLDTDEDDIDDSDSQQYDISPAEAKLVAKEIIRLHKEENVPFQDITLLVSSRTRNDGILQTFDRYGIPLVTDGGEQNYLKSVEVMVMLDTLRSIDNPLNDYALVALLRSPMFGFNEDDLTRIAIQDVKMAFYHKVKLSYHKEGHHSDLITPELSSKIDHFMKTFQTWRDFAKWHSLYDLIWKIYNDRFYYDYVGALPKAEQRQANLYALALRANQFEKTGFKGLSRFIRMIDKVLENENDLADVEVALPQNAVNLMTIHKSKGLEFKYVFILNIDKKFSMVDITSPLILSRNQGIGIKYVADMRHELEEEILPAVKVSMETLPYQLNKRELRLATLSEQMRLLYVAMTRAEKKLYLVGKASQTKWADHYDLVSENNHLPLASRETFVTFQDWLLAVHETYKKQELFYDINFVSLEELTDHHIGMVNPSLPFNPDNKVENRQSEDIVRAISVLESVEQINQTYKAAIELPTVRTPSQVKKIYEPILDIEGVDVMETITKTSVDFKLPDFSTSKKQDPAALGSAVHELMQRIEMSSHVKMEDIQKALTEVNAETSVKAAIQIEKINYFFQETSLGKYIQEEVEHLHREAPFAMLKEDPESGEKFVVRGIIDGYLLLENRIILFDYKTDKFVNPLELKERYQGQMALYAEALKKSYEIEKIDKYLILLGGKQLEVVKMD

SEQ ID NO: 9773 - DNA, 1374 bp, Streptococcus agalactiae
atgtctattacaaaagaatttgataccatcgcagctatttcaactcctctcggtgagggagctattggtattgtccgtatatctggtacagatgccttaaagatagcatcaaaaatttatcgtggaaaagatctatccgcgatccaatcccataccttaaactatggtcatattgtggacccagataaaaatgaaatcttggatgaagttatgttaggcgttatgcttgctccaaaaacattcacaagagaagatgttattgaaattaatacgcatggaggaattgcagttactaacgaaattcttcagttaattttacgacatggagcacgaatggctgaaccaggagaatttactaaacgtgcttttttaaatggtcgagttgacttgactcaggctgaagctgttatggatcttattagagctaaaacagataaagcaatggatattgccgttaagcaattagatggttctttaaagacactaatcaataacactcgacaagaaattttaaatactctagcccaagttgaagttaatatcgattaccctgaatatgatgacgttgaagagatgactacaacactgatgcgtgaaaaaacacaagagtttcaagcacttatggaaaatttacttcgaactgccagacgtggaaaaattcttcgagaaggactttcaacagcaatcattggtcgtccaaatgtcggtaaatccagcttactaaataacctcttacgtgaagaaaaggcgattgtgacagatattgaaggaacaactcgtgatgttattgaagaatacgtcaatattaaaggagttcctttaaaactagttgacactgctggtatccgtgatacagatgatatcgttgaaaaaattggtgttgaacgttcaaagaaggctttagaagaagccgaccttgtgttgttggttctcaatagttccgaaccactaacattacaagaccgctcccttctagaactaagtaaagaaagtaatcgtatcgtattactcaataaaacggatcttcctcaaaaaatagaagttaacgaattacctaaaaatgttattccaatttcggttttagaaaatgaaaacatcgataaaatcgaagaacgtattaacgatattttctttgacaacgctggtatggtagaacatgacgctacttatctatcaaatgctcgccatatctcactaattgaaaaagccgttgatagtttaaaagctgtcaatgagggcttggaattaggaatgcctgttgatctcttacaagtcgatatgactagaacttgggaaatacttggagaaatcactggggatgcagctccagatgaactaataactcagctcttcagccaattctgcttaggtaaa

SEQ ID NO: 9774 - protein, 458 aa, Streptococcus agalactiae
MSITKEFDTIAAISTPLGEGAIGIVRISGTDALKIASKIYRGKDLSAIQSHTLNYGHIVDPDKNEILDEVMLGVMLAPKTFTREDVIEINTHGGIAVTNEILQLILRHGARMAEPGEFTKRAFLNGRVDLTQAEAVMDLIRAKTDKAMDIAVKQLDGSLKTLINNTRQEILNTLAQVEVNIDYPEYDDVEEMTTTLMREKTQEFQALMENLLRTARRGKILREGLSTAIIGRPNVGKSSLLNNLLREEKAIVTDIEGTTRDVIEEYVNIKGVPLKLVDTAGIRDTDDIVEKIGVERSKKALEEADLVLLVLNSSEPLTLQDRSLLELSKESNRIVLLNKTDLPQKIEVNELPKNVIPISVLENENIDKIEERINDIFFDNAGMVEHDATYLSNARHISLIEKAVDSLKAVNEGLELGMPVDLLQVDMTRTWEILGEITGDAAPDELITQLFSQFCLGK

SEQ ID NO: 9775 - DNA, 1908 bp, Streptococcus agalactiae
atgattatactacaaggaaacaaaattgagcgctcattttcaggtgatgtgctttttgataatattaatattcaagttgatcaacgtgatcgtattgctcttgttggacgtaatggtgctggcaaatcaacgcttcttaaaattttagttggtgaagaggctccgacaaaaggagaaataaataaaaagcgtgatttgagtttgtcctacttggcacaagatagtcgttttcaatctgaaaatacaattttccaagaaatgttacaagtttttgactcattaagagaagtagagaagcgcttacgtgaattggaattacaaatggggcaagtttcaggaagtgacctggaacaattgatgaaaacatacgatattttgtcagaagagtttcgtgaaaaaggtggctttacctatgaatcagatataaaggctattttaaatggttttaagtttaacagtgatatgtgggaaatgcctattagtgaattgtctggcgggcaaaatacacgattagcgcttgcaaaaatgctacttgaaaagccagaattacttgttttagatgaaccaacgaaccatttagacattgatacgattgcttggttagaaaattatcttgtaaattatcaaggagcccttattattgtcagccatgaccgctattttttagacaaggtagctacagtaacttatgatttaacgacacattctctagaccgctatgtaggcaattattcgaaatttatggatcttaaggcagagaaaatagcgactgaagaaaagaattttgaaaaacaacaaaaagaaattgctaagttagaagattttgtacaacgtaacattgttagggcttcaaccactaaacgagcacaagctcgtcgtaaacaattagaaaagatggaacgactcgacaaaccgaatgtagagcaaaaatcagctaatatgacttttcatgctgggaaagtctcagggaatgttgttttaacacttgagaatgcagctattggttatgaaggtgtttctttatcggagccaatcgatttggacgtgaagaaatttgatgctattgcaattgtaggtccaaatggtatcgggaaatcaactttaatcaaatcgcttgttgggcaaattccttttatcaaaggagaagcaaaattaggagcaaatgtcgaaactgggtattacgatcaaagtcaaagtaatttaacaaaaacgaatactgttttagatgagttatgggatgctttttcaacaacgccagaagttgaaattagaaaccgtttaggagcttttcttttttcaggtgatgatgttaaaaaatcagtttcaatgctatcaggtggtgaacgagcgcgtttgctattggcaaaattatctatggaaaataataattttctcatattagatgagccaacaaaccacttggatattgatagtaaagaagtcttagaaaatgcactcatcgaatttgatggcacattactttttgttagtcatgatcgctattttattaatcgtgtggcaactaaggttctcgaaatttctgataagggaagtactctctatctaggagattatgattattacctcactaagaaagccgaactagaggaattagcacgtttaaatgaagaagaagtgagtgcttcaaaaacagaaatcgacgttacatcagattatgagacacaaaaagcaaatcaaaaggaatttaggaaaattacccgtcgcgttgtagaaattgaggcgcgtttggaagttcttgaaaatgatgaaaacaatatcaatggtttaatgttagaaaccaatgacatcggaaaactctctgatttgcaaaaagagctggaatcaatccaagaagaacaattgctattaatggaagagtgggaaaatctaaatatgagactagatttg

SEQ ID NO: 9776 - protein, 636 aa, Streptococcus agalactiae
MIILQGNKIERSFSGDVLFDNINIQVDQRDRIALVGRNGAGKSTLLKILVGEEAPTKGEINKKRDLSLSYLAQDSRFQSENTIFQEMLQVFDSLREVEKRLRELELQMGQVSGSDLEQLMKTYDILSEEFREKGGFTYESDIKAILNGFKFNSDMWEMPISELSGGQNTRLALAKMLLEKPELLVLDEPTNHLDIDTIAWLENYLVNYQGALIIVSHDRYFLDKVATVTYDLTTHSLDRYVGNYSKFMDLKAEKIATEEKNFEKQQKEIAKLEDFVQRNIVRASTTKRAQARRKQLEKMERLDKPNVEQKSANMTFHAGKVSGNVVLTLENAAIGYEGVSLSEPIDLDVKKFDAIAIVGPNGIGKSTLIKSLVGQIPFIKGEAKLGANVETGYYDQSQSNLTKTNTVLDELWDAFSTTPEVEIRNRLGAFLFSGDDVKKSVSMLSGGERARLLLAKLSMENNNFLILDEPTNHLDIDSKEVLENALIEFDGTLLFVSHDRYFINRVATKVLEISDKGSTLYLGDYDYYLTKKAELEELARLNEEEVSASKTEIDVTSDYETQKANQKEFRKITRRVVEIEARLEVLENDENNINGLMLETNDIGKLSDLQKELESIQEEQLLLMEEWENLNMRLDL

SEQ ID NO: 9777 - DNA, 966 bp, Streptococcus agalactiae
atggtaactctatctaaagaacaacacttggatatgtttctaaaaatgcaacgtattcgtgatgttgatatgaaatttaacaaattggttcgtcgtggtttcgtccaagggatgactcacttctctgttggtgaagaagctgcttcagtaggtgctatccaagatttaacagattcagatatcattttctcaaaccaccgtggacacggacaaactattgcaaaaggtattgatattggtggaatgtttgctgaacttgctggtaaagcaacaggaacatcaaaaggtcgtggaggctcaatgcacttagcaaaccttgaaaaaggtaactatggaacaaacggtatcgtcggtggaggatatgcgcttgcagtaggtgctgcccttacacagcaatatgaaggaactgataacattgttatcgccttttcgggtgactcagcgactaacgagggctcattccatgagtcagttaacttagctgctgtttggaacttaccagttatcttctttatcatcaacaaccgttatggtatctcaacagacatcacatactcaactaaaattcctcacctttacatgcgtgctgatgcgtacggtattccagggcattatgttgaagatggtaatgaccttatggctgtttacgagaaaatgcatgaagttatcaattacgtgcgttcaggaaatggaccagctattgtagaggttgaatcataccgttggtttggtcattcaactgctgatgctggggtataccgtactaaagaagaagttgattcatggaaagctaaagatccagtaaaacgctaccgtgcatacttaattgaaaatgaaatcgctactgaagaagagcttgcagctattgaagcacaagtgattaaagaagttgaagaaggggttaaattcgctgaagaaagtccattccctgatatgtctgttgcatttgaagacgtttttgtggac

SEQ ID NO: 9778 - protein, 322 aa, Streptococcus agalactiae
MVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVIAFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 9779 - DNA, 858 bp, Streptococcus agalactiae
atgttagaagagtttggtgctaagcgcgttcgcgacacaccaatctcagaggctgcgattgcaggttcagctatcggtgctgcacaaacaggtttgcgtcctatcgttgatttgacattcatggattttgtaacaatcgcaatggatgctatcgttaaccaaggtgctaaaacgaattatatgtttggtggaggtctatcaactccagttactttccgtgtggcatcagggtcaggtattggttcggctgcacaacactcacaatcattagaagcttggttaacacacattccaggtctaaaagttgttgcacctggtactgttaatgagtcaaaagcacttttgaaatcttctattcttgacaataacccagttatcttcttagagccaaaagctctctatggtaagaaagaagaagttaatatggaccctgatttctatattccacttggtaaaggggatattaagcgtgaggggactgacttaacaattgtttcttatggccgtatgcttgagcgtgttatgcaagctgctgaagaagttgctgaggaaggtattaacgttgaggttgttgatccacgtacacttattccgcttgataaagaattaattatcgattctgttaagaaaactggtaaattgatcttggttaacgatgcttataaaactggtggtttcactggtgaaattgcaactatggttgctgaaagtgaagcatttgattaccttgatcatcctatcgtgcgtcttgcaagtgaagatgttccagtaccgtattcacgtgtacttgaacaaggaatcttacctgatgtagcaaaaattaaagatgctatctataaagtagttaacaaaggtaaa

SEQ ID NO: 9780 - protein, 286 aa, Streptococcus agalactiae
MLEEFGAKRVRDTPISEAAIAGSAIGAAQTGLRPIVDLTFMDFVTIAMDAIVNQGAKTNYMFGGGLSTPVTFRVASGSGIGSAAQHSQSLEAWLTHIPGLKVVAPGTVNESKALLKSSILDNNPVIFLEPKALYGKKEEVNMDPDFYIPLGKGDIKREGTDLTIVSYGRMLERVMQAAEEVAEEGINVEVVDPRTLIPLDKELIIDSVKKTGKLILVNDAYKTGGFTGEIATMVAESEAFDYLDHPIVRLASEDVPVPYSRVLEQGILPDVAKIKDAIYKVVNKGK

SEQ ID NO: 9781 - DNA, 1278 bp, Streptococcus agalactiae
atgggacgtggctctacttatccgggtagtttagcactcaaattcgataaagatatactagatacaattgccaaagattatgaaattgtagttgtgactggtactaacggtaaaaccttaacaacagctttaacagttggtattttaaaggaagccttcggtcaggtggtaaccaacccaagtggagcaaatatgattacaggtattgtttcgaccttcctaacagctaagaaaagtaaatctggtaaaaaaatagctgtccttgaaatagacgaagcgagtttaccccgtattacacagtatataaagcctagtttgttcgtctttaccaatattttccgtgatcaaatggaccgttatggcgaaatctacacaacttatcaaatgattttagatggagctgctaacgctccgcaagctactatcttagctaacggtgacagtccactttttaattctaaaagcgtgactaaccctgtgcaattctatggatttaataccgacaaacatgagccacgattagcacactataatactgagggtattctctgtccaaagtgtcaagcaattttaacttatcgattgaacacatatgccaaccttggtgactacacttgtcctaattgtgattttgaacgtccaaaccttgattatgccttaacaaggctaacacatctgacaaatacttcatcaggtttcgttattgatggccaacaatataatatcaacgtgggtggcctttataatatttacaatgctttggcggcagtatctgttgctgaatattttggtgtagaaccaagtcaaattaaggatggatttgataaaagccgtgccgtttttggtcgtcaagaaacctttacaattggaaataaaaaatgtactttagttctgattaaaaatccggtaggagctagtcaagctcttgatatgattaaacttgctccatacccgttctctctctcagtactactgaatgccaattatgctgacggtattgatacttcttggatttgggacgctaattttgaaactattctcacgatgaatatcccagaaatatttgctggtggtgttcgccactctgaaattgctcgtcgcttacgtgtaactggttatgatgagaaacgcataaaacaagctgataaactgcaagatattatgacaatgattgagcagcaagagactgagcatgcttatattttagcaacatatacagctatgctggagtttcgtgaaattcttgctaaccacaacgctatcagaaaggagatgaat

SEQ ID NO: 9782 - protein, 426 aa, Streptococcus agalactiae
MGRGSTYPGSLALKFDKDILDTIAKDYEIVVVTGTNGKTLTTALTVGILKEAFGQVVTNPSGANMITGIVSTFLTAKKSKSGKKIAVLEIDEASLPRITQYIKPSLFVFTNIFRDQMDRYGEIYTTYQMILDGAANAPQATILANGDSPLFNSKSVTNPVQFYGFNTDKHEPRLAHYNTEGILCPKCQAILTYRLNTYANLGDYTCPNCDFERPNLDYALTRLTHLTNTSSGFVIDGQQYNINVGGLYNIYNALAAVSVAEYFGVEPSQIKDGFDKSRAVFGRQETFTIGNKKCTLVLIKNPVGASQALDMIKLAPYPFSLSVLLNANYADGIDTSWIWDANFETILTMNIPEIFAGGVRHSEIARRLRVTGYDEKRIKQADKLQDIMTMIEQQETEHAYILATYTAMLEFREILANHNAIRKEMN

SEQ ID NO: 9783 - DNA, 324 bp, Streptococcus agalactiae
atgcgaatgattttaatgtttgatatgcctactgaaacagcagaagaacggaaggcgtatcgtaagtttagaaagtttctcttgagcgaaggctttatcatgcatcagttttctgtttatagtaaattattactcaataatacagctaataatgctatgataggtcggcttaaagtgaataatcctaaaaagggtaatatcacactcttaacagttacggaaaaacaatttgcgagaatggtttacctccatggagaacgcaacacaagtgttgccaactctgatagtcgcttggttttcctaggagattcttatgatcaagat

SEQ ID NO: 9784 - protein, 108 aa, Streptococcus agalactiae
MRMILMFDMPTETAEERKAYRKFRKFLLSEGFIMHQFSVYSKLLLNNTANNAMIGRLKVNNPKKGNITLLTVTEKQFARMVYLHGERNTSVANSDSRLVFLGDSYDQD

SEQ ID NO: 9785 - DNA, 609 bp, Streptococcus agalactiae
atggttcaccataaattaaaaaatgatccaagtggccatgactggtttcatattgttagagtaagaaatcttgcggtagaattagcacacaaagaaggggctaatacctttatttgtcaaatggctgcacttttgcatgatattattgatgacaaaatctgccaagatagtaagcaagcgtcgtatgaattgactcaatggttatatagtcaagatcttgccatagcagaagtagaacatatccttgatattcttgaaaatatttcattcaaagcaggaactggattgactatgaaaacattggaaggtcaaattgttcaagatgcagatcgcctagatgctatgggggctattggtattgcaagaacgatggcttattcagggagtaaaggacgtttaattcatgaccctaacttaaaaccacgagaaaacctcactttagaagagtatcgtaatggtcaggatacagctatcattcatttttacgaaaaattattaaagttaaaagaccttatgaatacaaaacaagggaaaatgcttgctcaaaaacgtcatgattttttagaactatatttagccgaattttatgctgaatggaatggtaaacgt

SEQ ID NO: 9786 - protein, 203 aa, Streptococcus agalactiae
MVHHKLKNDPSGHDWFHIVRVRNLAVELAHKEGANTFICQMAALLHDIIDDKICQDSKQASYELTQWLYSQDLAIAEVEHILDILENISFKAGTGLTMKTLEGQIVQDADRLDAMGAIGIARTMAYSGSKGRLIHDPNLKPRENLTLEEYRNGQDTAIIHFYEKLLKLKDLMNTKQGKMLAQKRHDFLELYLAEFYAEWNGKR

SEQ ID NO: 9787 - DNA, 1917 bp, Streptococcus agalactiae
atgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctgccgaaattgtaatcaaacagaaggtagaactgtatcctaatatgtgtgtgacgaactttaccgaatctgaacaatgggatacggtaatagagggaaacgatgaccttttagagaaatatatgtccggtaaatcattagaagcattggaactcgaacaagaggaaagcataagatttcataattgttccctgttccctgtttatcacggaagtgcaaaaaacaatatagggattgataaccttatagaagtgattacgaataaattttattcatcaacacatcgaggtccgtctgaactttgcggaaatgttttcaaaattgaatatacaaaaaaaagacaacgtcttgcatatatacgcctttatagtggagtactacatttacgagattcggttagagtatcagaaaaagaaaaaataaaagttacagaaatgtatacttcaataaatggtgaattatgtaagattgatagagcttattctggagaaattgttattttgcaaaatgagtttttgaagttaaatagtgttcttggagatacaaaactattgccacagagaaaaaagattgaaaatccgcaccctctactacaaacaactgttgaaccgagtaaacctgaacagagagaaatgttgcttgatgcccttttggaaatctcagatagtgatccgcttctacgatattacgtggattctacgacacatgaaattatactttctttcttagggaaagtacaaatggaagtgattagtgcactgttgcaagaaaagtatcatgtggagatagaactaaaagagcctacagtcatttatatggagagaccgttaaaaaatgcagaatataccattcacatcgaagtgccgccaaatcctttctgggcttccattggtttatctgtatcaccgcttccgttgggaagtggaatgcagtatgagagctcggtttctcttggatacttaaatcaatcatttcaaaatgcagttatggaagggatacgctatggttgcgaacaaggattatatggttggaatgtgacggattgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataact

SEQ ID NO: 9788 - protein, 639 aa, Streptococcus agalactiae
MKIINIGVLAHVDAGKTTLTESLLYNSGAITELGSVDKGTTRTDNTLLERQRGITIQTGITSFQWENTKVNIIDTPGHMDFLAEVYRSLSVLDGAILLISAKDGVQAQTRILFHALRKMGIPTIFFINKIDQNGIDLSTVYQDIKEKLSAEIVIKQKVELYPNMCVTNFTESEQWDTVIEGNDDLLEKYMSGKSLEALELEQEESIRFHNCSLFPVYHGSAKNNIGIDNLIEVITNKFYSSTHRGPSELCGNVFKIEYTKKRQRLAYIRLYSGVLHLRDSVRVSEKEKIKVTEMYTSINGELCKIDRAYSGEIVILQNEFLKLNSVLGDTKLLPQRKKIENPHPLLQTTVEPSKPEQREMLLDALLEISDSDPLLRYYVDSTTHEIILSFLGKVQMEVISALLQEKYHVEIELKEPTVIYMERPLKNAEYTIHIEVPPNPFWASIGLSVSPLPLGSGMQYESSVSLGYLNQSFQNAVMEGIRYGCEQGLYGWNVTDCKICFKYGLYYSPVSTPADFRMLAPIVLEQVLKKAGTELLEPYLSFKIYAPQEYLSRAYNDAPKYCANIVDTQLKNNEVILSGEIPARCIQEYRSDLTFFTNGRSVCLTELKGYHVTTGEPVCQPRRPNSRIDKVRYMFNKIT

SEQ ID NO: 9789 - DNA, 912 bp, Streptococcus agalactiae
atgatgaaatttagaaaaaatcagaataaagaaaaacagataccaaaggaaaagaaacctcgtgtctataaggtcaatcctcataaaaaggttgtgattgccttgtgggtacttttagggcttagtttcagctttgcgatattcaagcactttacagctatagatactcatactattcacgaaacaactatcatagaaaaggaatacgttgatactcatcatgtagaaaattttgtagagaactttgcgaaagtctactattcatgggagcaatccgataagtccattgataatcgaatggaaagtctaaaaggctatctgacagatgaacttcaagctctcaatgttgatacagtacgcaaagatattcctgtatcgtcttctgtaagaggatttcagatatggacggtagagccaactggcgacaatgagtttaatgtaacctacagtgtagaccagctcattacagagggagaaaatacaaagaccgtccactctgcttatatagtgagtgtctatgtagatggttctggaaatatggtactggttaagaatccgaccattaccaacatacctaagaaatcaagttataaaccaaaagccattgaaagtgaggggacggttgattccattacaaccaatgaaatcaatgagtttttaacgacgttcttcaagctctatcctacagcgacagccagtgaactttcctactatgtgaatgacgggatattaaaaccaatcggaaaagagtacatctttcaagaactggtaaatcctattcacaatcgtaaggataatcaagtcacggtatcgctgacagtggagtatatcgaccagcagaccaaagcaacgcaggtatctcaatttgatttggtacttgaaaagaacgggagtaattggaagattgtaaaa

SEQ ID NO: 9790 - protein, 304 aa, Streptococcus agalactiae
MMKFRKNQNKEKQIPKEKKPRVYKVNPHKKVVIALWVLLGLSFSFAIFKHFTAIDTHTIHETTIIEKEYVDTHHVENFVENFAKVYYSWEQSDKSIDNRMESLKGYLTDELQALNVDTVRKDIPVSSSVRGFQIWTVEPTGDNEFNVTYSVDQLITEGENTKTVHSAYIVSVYVDGSGNMVLVKNPTITNIPKKSSYKPKAIESEGTVDSITTNEINEFLTTFFKLYPTATASELSYYVNDGILKPIGKEYIFQELVNPIHNRKDNQVTVSLTVEYIDQQTKATQVSQFDLVLEKNGSNWKIVK

SEQ ID NO: 9791 - DNA, 924 bp, Streptococcus agalactiae
atggcatatccaattaaatacattgaaaacaatctcgtctggaataaagacggggaatgttatgcttactatgagcttgttccttacaattactcatttctaagtccagaacagaaaatacaagtgcatgattctttcagacagcttatcgcacaaaatcgtgatggcaaaattcatgctttacaaatcagtacagaatccagcatacgttctgcacaagagcgttccaaaaatgaagtcactggcaagctcaaagcggttgcctatgacaaaatcgaccaacagacagacgctttaatatccatgattggcgaaaatcaagtgaactaccgtttctttatcggctttaagttgcttctcaacgatcaggagttttctatgaaaagtcttaccgttgaagcaaaaaatgctttgtctgattttgtctatgatgtgaaccataagctgatgggcgattttgttagtatgagtaatgatgaaatcctgcgttttcagaagatggaaaagctcttagaaaataaaatctctcgtcgtttcaaaatccgcaggttagataaggacgacttcggctatctgattgaacacctttacggacagacaggcactgcctatgaagagtatgagtaccatctatcaaagaaaaagctggataatgaaacgctgattaaatactatgacttgattaagcctactcgctgtttggtggaagaaaaacagcgatatttgaaaatccagcaggaagatgaaaccgtctatgtagcttactttaccattaacagcattgtcggagaactggacttcccgtcctctgaaatcttctactaccagcaacagcaatttacattcccgattgatacgtcaatgaatgtggaaattgtagcgaatcgtaaagccctatctactgtccgcaaaaaaagaaagaac

SEQ ID NO: 9792 - protein, 308 aa, Streptococcus agalactiae
MAYPIKYIENNLVWNKDGECYAYYELVPYNYSFLSPEQKIQVHDSFRQLIAQNRDGKIHALQISTESSIRSAQERSKNEVTGKLKAVAYDKIDQQTDALISMIGENQVNYRFFIGFKLLLNDQEFSMKSLTVEAKNALSDFVYDVNHKLMGDFVSMSNDEILRFQKMEKLLENKISRRFKIRRLDKDDFGYLIEHLYGQTGTAYEEYEYHLSKKKLDNETLIKYYDLIKPTRCLVEEKQRYLKIQQEDETVYVAYFTINSIVGELDFPSSEIFYYQQQQFTFPIDTSMNVEIVANRKALSTVRKKRKN

SEQ ID NO: 9793 - DNA, 1146 bp, Streptococcus agalactiae
ttggcttatggactatctcaaaaccgtttagctgttgcgactggtattacaaggcagtatctaagcgatattgaaacaggaaaagtcaagccatcagaggatttacagcagtccctttgggaagctctggaacgcttcaatcccgacgctccccttgaaatgctgtttgattatgtaagaattcgctttccgacaacagacgtacagcaggtggtcgaaaacatcttacaactgaaactgtcctattttcttcatgaggactatggtttctattcttattcagagcattatgctttaggcgacatattcgtcctttgctcccatgaactggacaaaggagttctggtggaattgaaaggtcgtgggtgcagacaatttgaaagctatcttctggcacaacaaagaagctggtatgagttctttatggacgttttggtggctggcggtgtgatgaaacgccttgaccttgccattaacgataagacagggattttaaatatccctgtactcactgaaaagtgccaacaggaagaatgtatctccgtcttccgcagttttaaaagctatcgcagtggcgaactggtacgcaaagaggaaaaggaatgtatgggaaacaccctctatatcggttcattacaaagtgaagtttatttctgtatctatgaaaaggactacgagcagtacaagaaaaatgatattcccattgaagacgcagaagtaaaaaaccgttttgagattcgattgaaaaatgagcgtgcctattatgcagtccgtgatttactcgtctatgacaatccagagcataccgcctttaaaattatcaatcggtatatccgttttgtagataaagacgattccaaacctcgttctgattggaaactgaatgaagaatgggcttggtttattgggaacaatcgtgaacgattaaaactaaccacaaaaccagagccttactccttccaaaggacgctgaactggctatctcatcaagttgccccgaccttaaaggttgcgattaaacttgatgaaatcaaccagacgcaggttgtaaaagacattctcgaccatgcgaaactgacagaccgacacaagcagattttgaagcaacagtcagtaaaagaacaggacgtgataacaacaaaaaaa

SEQ ID NO: 9794 - protein, 382 aa, Streptococcus agalactiae
MAYGLSQNRLAVATGITRQYLSDIETGKVKPSEDLQQSLWEALERFNPDAPLEMLFDYVRIRFPTTDVQQVVENILQLKLSYFLHEDYGFYSYSEHYALGDIFVLCSHELDKGVLVELKGRGCRQFESYLLAQQRSWYEFFMDVLVAGGVMKRLDLAINDKTGILNIPVLTEKCQQEECISVFRSFKSYRSGELVRKEEKECMGNTLYIGSLQSEVYFCIYEKDYEQYKKNDIPIEDAEVKNRFEIRLKNERAYYAVRDLLVYDNPEHTAFKIINRYIRFVDKDDSKPRSDWKLNEEWAWFIGNNRERLKLTTKPEPYSFQRTLNWLSHQVAPTLKVAIKLDEINQTQVVKDILDHAKLTDRHKQILKQQSVKEQDVITTKK

SEQ ID NO: 9795 - DNA, 1296 bp, Streptococcus agalactiae
atggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaa

SEQ ID NO: 9796 - protein, 432 aa, Streptococcus agalactiae
MATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 9797 - DNA, 555 bp, Streptococcus agalactiae
atggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagag

SEQ ID NO: 9798 - protein, 185 aa, Streptococcus agalactiae; identical to SEQ ID NO: 8790

SEQ ID NO: 9799 - DNA, 468 bp, Streptococcus agalactiae
atgatagattatggtagtcaagtccttctaaatagtttacattttgaaaaaaataaatccttgttagaccttgggtgtggatacggtccgctgggaatttctctagccaaagtgcaaggagttaaagcaactatggttgacattaatacgagagcattggaattagctaagaaaaatgcaacacgcaatggagtagtagttgaagtctttcagtcaaacatttatgaaaatatttctaaaactttcgactatattataagcaacccacctattcgtgctggaaagcaagttgttcattctattatcgaagaaagtatctgttaccttaatacaggcggtagccttaccattgtcattcaaaagaaacaaggcgctccaagtgcaaaagctaaaatgctagatacttttggtaattgcgatattttaaaaaaagataagggatattatatattgagaagtgaaaaagtc

SEQ ID NO: 9800 - protein, 156 aa, Streptococcus agalactiae
MIDYGSQVLLNSLHFEKNKSLLDLGCGYGPLGISLAKVQGVKATMVDINTRALELAKKNATRNGVVVEVFQSNIYENISKTFDYIISNPPIRAGKQVVHSIIEESICYLNTGGSLTIVIQKKQGAPSAKAKMLDTFGNCDILKKDKGYYILRSEKV

SEQ ID NO: 9801 - DNA, 414 bp, Streptococcus agalactiae
atgaagcgaaaggtgcagctactaaaaatgggaaatatagagttgaaaaaattggctgtaaaagcgagtgaaaatgcatacgttccttactcgaaatttccagtaggcgcagcattgcgtacagcagaaggaaaaatatttacaggatgtaacgttgaaaatatcagttatggattagcaaactgtgctgagcgtactgcaatttttaaagctgtttcagaaggttataaagatttttcggaaattgctatttatggaaatactgaagaaccaatttctccttgcggtgcatgccgtcaagtgatggtggaattttttaataagaatgctaaagttacattgattgctaaaaatggtaagacggtcgagacgacggtcggtgagttgttaccatactcgtttgttgatttaaaa

SEQ ID NO: 9802 - protein, 138 aa, Streptococcus agalactiae
MKRKVQLLKMGNIELKKLAVKASENAYVPYSKFPVGAALRTAEGKIFTGCNVENISYGLANCAERTAIFKAVSEGYKDFSEIAIYGNTEEPISPCGACRQVMVEFFNKNAKVTLIAKNGKTVETTVGELLPYSFVDLK

SEQ ID NO: 9803 - DNA, 1533 bp, Streptococcus agalactiae
atgacacagaatgtcattgaaatgaaagaaatcactaagaaattcggtgattttgtggcaaatgatcatatcaatttgacggttgaaaaaggtgagatacatgctctgcttggcgaaaacggtgcagggaaatcaactttaatgaacatgttagcaggtttactagaaccaacagacggtcaaatttttattaatggtcagcctgtaactattgattcaccttccaaatcgtcacaattggggattggtatggtacatcagcatttcatgcttgttgaagcatttactgtagctgaaaatattgttctaggaaatgaaaccacccaaaatggtgttttagacattaagacagcagctaaagaaataaaggaactatcagagaaatatggtttgtcagtaaatccaaatgctaaaatatctgatatttctgtaggagcacagcagcgtgttgaaattttgaagacactttatcgcggtgcagatattttaatttttgatgagccgacggcggtgcttacaccatcagaaataaaagaattgatgacaattatgaagagccttgttaaagaaggcaaatccattatactaattacccataaattggatgaaattcgggcagttgctgataaagttactgtgattcgccgtggtaaaagtattgaaacagtccctgttgcaggcgcaagttctcaacaactggcggaaatgatggttggacgatctgtttccttcagaactgaaaaaaaggaagctaatccgactgacataatcctttctgtaaaggatttagttgtagaagaaaatagaggcggcgttctagctgttaaaaatctgtcgttagatgttcgagcaggtgaaattgtaggtatagctggtattgatggtaatggacaaagtgaattaattcaagctattacaggtttaagaaaggtaacttctggtcaaattgtaattaaaggtaaagatgtcacaaaattttcaagtcgacaaattacagaattaagtgtaggtcatgttccagaagatcgtcatagagatggtttggttctagatatgacgatggcagaaaatttagctttacaaacttattataaagagccattgagtcataaaggtatccttaattttgctaaaattaaagagtatgctcgtcaattaatgacagaatttgatgtgcgtggtgctggtgaacatgttttagcaagaggattttctggtggtaaccaacaaaaagcaattattgctcgtgaagtggatcgcgatccagacctactcattgttagccaaccgactcgtggtctagatgttggtgctatcgagtatattcataaacgtttgattgaagagcgcgataaagggaaagcggtcttagtagttagctttgagttagatgaaatcttaaacttatcagatcgtattgcagttattcatgatggtaaaattcaaggaattgttaaacccgaccaaaccaacaagcaagaattgggtattttgatggctggtggaaaaattgaaaaggaggagagagatgtc

SEQ ID NO: 9804 - protein, 511 aa, Streptococcus agalactiae
MTQNVIEMKEITKKFGDFVANDHINLTVEKGEIHALLGENGAGKSTLMNMLAGLLEPTDGQIFINGQPVTIDSPSKSSQLGIGMVHQHFMLVEAFTVAENIVLGNETTQNGVLDIKTAAKEIKELSEKYGLSVNPNAKISDISVGAQQRVEILKTLYRGADILIFDEPTAVLTPSEIKELMTIMKSLVKEGKSIILITHKLDEIRAVADKVTVIRRGKSIETVPVAGASSQQLAEMMVGRSVSFRTEKKEANPTDIILSVKDLVVEENRGGVLAVKNLSLDVRAGEIVGIAGIDGNGQSELIQAITGLRKVTSGQIVIKGKDVTKFSSRQITELSVGHVPEDRHRDGLVLDMTMAENLALQTYYKEPLSHKGILNFAKIKEYARQLMTEFDVRGAGEHVLARGFSGGNQQKAIIAREVDRDPDLLIVSQPTRGLDVGAIEYIHKRLIEERDKGKAVLVVSFELDEILNLSDRIAVIHDGKIQGIVKPDQTNKQELGILMAGGKIEKEERDV

SEQ ID NO: 9805 - DNA, 822 bp, Streptococcus agalactiae
atggtaattggagctttctcaggcgttgtatttaatttagagtttgcttctgtttttggtgatgcgactccatggatttctgtactagttggtggtttagttggtttaattttttctgttatccatgcagttgcgacagttaattttcgtgcagatcatattatcagcggaaccgttcttaatttaatggcaccttcattagctgttttcttgattaaggttctttataataaaggtcaaactgataatattcaagaatcatttggaaaatttaatttccctatactatcagatattccttttgttggtgatatcttctttaaaggaacaagcttagtcggttatattgctattcttttctcattccttgcttggtttattctatataaaactcgctttggattaagattacgctcagttggagaacatcctcaagcagcagacaccttaggtattaatgtttatcttatgcgttactctggtgtcttgatttcaggtttccttggtggaataggaggagctgtatatgctcaatctatttctgttaactttgcagcgacaactatattaggaccgggctttatctccttagcggcgatgatttttggtaagtggaatccaattggtgcaatgcttgctagtctattctttggtttatcgcaaagtttagcagttatcggtagccatttaccacttttgagcaatattccaacagtttatctacaaattgctccatatgtcctcactatcattgtattagcagctttctttggacaagcagtagctcctaaggcggatggtattaattatattaaaacgaaa

SEQ ID NO: 9806 - protein, 274 aa, Streptococcus agalactiae
MVIGAFSGVVFNLEFASVFGDATPWISVLVGGLVGLIFSVIHAVATVNFRADHIISGTVLNLMAPSLAVFLIKVLYNKGQTDNIQESFGKFNFPILSDIPFVGDIFFKGTSLVGYIAILFSFLAWFILYKTRFGLRLRSVGEHPQAADTLGINVYLMRYSGVLISGFLGGIGGAVYAQSISVNFAATTILGPGFISLAAMIFGKWNPIGAMLASLFFGLSQSLAVIGSHLPLLSNIPTVYLQIAPYVLTIIVLAAFFGQAVAPKADGINYIKTK

SEQ ID NO: 9807 - DNA, 741 bp, Streptococcus agalactiae
atgcactataaagaattacttgagtcatccgaaaaagcttatttggaaactaatcggtataaacattttaagaatataatcatttcagagcgttatttttcaaactatattagctacaaaataatgcctacagtaagtgagtttttacaggatatgatctatttagcagatgaacaaaaagattatcagtctgattttgcttttgtattttttgaggaaaatgctgaattgagcagtgaattacagagaactttatcacaacaaggctttgaatcagagaaacatatcatatttacaaattcattaaatcatcttaaactttttgaaaaagaatttgatgacatcacatttactaaacttaatgaaaattacctagaaaaatacctaaagttcaaatataaacaaagtatagtttacggagaaatttacgctaagcaaatgtataatgataatcgtgttaatcttttaaataataatgctaaagtttacctagctattaaagataatcaaattattggagatgtaacagcttgggactatggtgaatacgtggaaatagatgatttttatgtccaagagtcctacagaggacaaggaattggtacgcgcctacaatttgatgcaagtagggggtttaagaaagttatcttaatttcagaagaagaaaacagaaaaatgtatgagcaccaaggttatgaggaagtcgcctattattggaccgctttacggagccctcgaaag

SEQ ID NO: 9808 - protein, 247 aa, Streptococcus agalactiae
MHYKELLESSEKAYLETNRYKHFKNIIISERYFSNYISYKIMPTVSEFLQDMIYLADEQKDYQSDFAFVFFEENAELSSELQRTLSQQGFESEKHIIFTNSLNHLKLFEKEFDDITFTKLNENYLEKYLKFKYKQSIVYGEIYAKQMYNDNRVNLLNNNAKVYLAIKDNQIIGDVTAWDYGEYVEIDDFYVQESYRGQGIGTRLQFDASRGFKKVILISEEENRKMYEHQGYEEVAYYWTALRSPRK

SEQ ID NO: 9809 - DNA, 1953 bp, Streptococcus agalactiae
atgttttatctcaaaatagcctggcataatttaaaacattctatagaccagtacataccattcctcttagccagtttattactttattcattgacttgttctacgctactaatcttaatgagtgctgttggaagagatatggggacagcggcaacggttctttttcttggagtgattgttttgtcaatctttgcggtagtcatggaacattatagctacaatatcttgatgaaacagcgtagtagtgaatttggactgtataacattttggggatgaataaacgtcaagttgcgcgtgtagctagtctagagctgtttattatttatatatttcttatttctataggaagtctgtttagtgctttttttgctaaatttatttatttaatttttgtcaacattattaactatcatgcactaaatcttagtttaagtttatggccatttattatttgtatcgttatatttacaggtatttttctgactttagaagttccagttattcgacatgttcatttatcatccccattaagtctttttagaaagaaacaacagggagaaaaagaaccaaaaggtaatcttatacttgcaattttagcgttagtagctatcgccatcgcttatacaatggctcttacttcaggtaaagcacctgcattagctgttatctatcgtttcttctttgcagtacttttagttattgctggtacttatcttttttatattagttttatgacatggtacttaaaaaggttgcgtcaaaacaagcattattattataaatctgagcattttgtatcaacttcgcaaatgatttttcgaatgaagcaaaatgcagtagggttagcaagtatcactttattagctgttatggctctagttactattgctacaacagtctcactttattcaaatacacaaaatgttgttaccggactatttccaaaatcagtaagtttatcaatagataattcaaaaggtgacgcgaaaaatatatttgaagaaaagattttgaagaaactaggtaagtcatctaaggaagctatcacttataatcagacaatgatttcgatgccagttagtcaatcaagtgaacttaatatcacatctaaaaacgtcaaacatgttgatatcacaaaaacgggttttatgtacctaattactcagaatgatttccgtcgtttaggtcaccaattaccaaaattaaaagataaccaagtggcttactttgttcaaaaaggtgatagccgtttgaaaaaaataaatctattgggaaataaatttgacgttgtaaaaaatttaaaagaggcttatgtcccagagactacaaatacttacaacccgggtttgattatatttgcaaacaacaaacaaattgacaatattagaaaagcatatttaccttatactaagaacatcaatacttttccaaaaacctttaaggcatatttggatttgaatagtcaagagataaattcaatttctaaaaacgacataatagaggtagatggtaagtatgttggaaatattagcactaaacagagttttctaaaagaaggttatcaaatgtttggtgggttattatttactggatttctgttaggtataagctttttgctaggtatagctctaattgtttactataagcaatactcagaaggtcatgaagataagagatcttatcgtatcttacaagaagtaggtatgagcaaaaaattagttaaacggactattaattctcaaattatgattttcttcttccaacctttagtggtagcagttattcactttggagttgctattccaatgctaaaacagatgcttttggtatttggggtgcttaactcaacaatcgtatatgtagtaagtggtttgacagtacttgcgatttctataatttactttatcatttaccgtataactagtcgaacttattatcatattattgaacgc

SEQ ID NO: 9810 - protein, 651 aa, Streptococcus agalactiae
MFYLKIAWHNLKHSIDQYIPFLLASLLLYSLTCSTLLILMSAVGRDMGTAATVLFLGVIVLSIFAVVMEHYSYNILMKQRSSEFGLYNILGMNKRQVARVASLELFIIYIFLISIGSLFSAFFAKFIYLIFVNIINYHALNLSLSLWPFIICIVIFTGIFLTLEVPVIRHVHLSSPLSLFRKKQQGEKEPKGNLILAILALVAIAIAYTMALTSGKAPALAVIYRFFFAVLLVIAGTYLFYISFMTWYLKRLRQNKHYYYKSEHFVSTSQMIFRMKQNAVGLASITLLAVMALVTIATTVSLYSNTQNVVTGLFPKSVSLSIDNSKGDAKNIFEEKILKKLGKSSKEAITYNQTMISMPVSQSSELNITSKNVKHVDITKTGFMYLITQNDFRRLGHQLPKLKDNQVAYFVQKGDSRLKKINLLGNKFDVVKNLKEAYVPETTNTYNPGLIIFANNKQIDNIRKAYLPYTKNINTFPKTFKAYLDLNSQEINSISKNDIIEVDGKYVGNISTKQSFLKEGYQMFGGLLFTGFLLGISFLLGIALIVYYKQYSEGHEDKRSYRILQEVGMSKKLVKRTINSQIMIFFFQPLVVAVIHFGVAIPMLKQMLLVFGVLNSTIVYVVSGLTVLAISIIYFIIYRITSRTYYHIIER

SEQ ID NO: 9811 - DNA, 684 bp, Streptococcus agalactiae
atgtatttagcattaatcggtgatatcattaattcaaaacagatacttgaacgtgaaactttccaacagtcttttcagcaactaatgaccgaactatctgatgtatatggtgaagagctgatttctccattcactattacagctggtgatgaatttcaagctttattgaaaccatcaaaaaaggtatttcaaattattgaccatattcaactagctctaaaacctgttaatgtaaggttcggcctcggtacaggaaacattataacatccatcaattcaaatgaaagtatcggtgctgatggtcctgcctactggcatgctcgctcagctattaatcatatacatgataaaaatgattatggaacagttcaagtagctatttgccttgatgatgaagaccaaaaccttgaattaacactaaatagtctcatttcagctggtgattttatcaagtcaaaatggactacaaaccattttcaaatgcttgagcacttaatacttcaagataattatcaagaacaatttcaacatcaaaagttagcccaactggaaaatattgaacctagtgcgctgactaaacgccttaaagcaagcggtctgaagatttacttaagaacgagaacacaggcagccgatctattagttaaaagttgcactcaaactaaagggggaagctatgatttc

SEQ ID NO: 9812 - protein, 228 aa, Streptococcus agalactiae
MYLALIGDIINSKQILERETFQQSFQQLMTELSDVYGEELISPFTITAGDEFQALLKPSKKVFQIIDHIQLALKPVNVRFGLGTGNIITSINSNESIGADGPAYWHARSAINHIHDKNDYGTVQVAICLDDEDQNLELTLNSLISAGDFIKSKWTTNHFQMLEHLILQDNYQEQFQHQKLAQLENIEPSALTKRLKASGLKIYLRTRTQAADLLVKSCTQTKGGSYDF

SEQ ID NO: 9813 - DNA, 306 bp, Streptococcus agalactiae
atgaatgccctttttgagttttatgcggcattattaacagataaacaaatgaattatatcgagttatactacgccgatgactacagccttgctgaaatagctgaagaatccggtgttagccgacaagctgtctatgataatatcaaacgaactgaaaaaattcttgaggcgtacgaaatgaaactacatatgtattcagattatattgtccgtagtcagatttttgatgacattctagaaaaatataccgatgatgcctttttacaagaaaaaatttccattctaagtagcattgataatagagat

SEQ ID NO: 9814 - protein, 102 aa, Streptococcus agalactiae
MNALFEFYAALLTDKQMNYIELYYADDYSLAEIAEESGVSRQAVYDNIKRTEKILEAYEMKLHMYSDYIVRSQIFDDILEKYTDDAFLQEKISILSSIDNRD

SEQ ID NO: 9815 - DNA, 555 bp, Streptococcus agalactiae
atgtataacggacataatgtttatagcccgcgcactgataccgtagaacttcgtaaagaaattgggatggtttttcagcagcctaatccatttcctatgtcagtatttgaaaatgttgtttatggtcttagactcaaaggaataaaagacaaagctacgttagatgaagccgtagagacttcattgaagggcgcgtctatctgggacgaggtcaaagatagattacacgactctgctcttggtttatctggtggtcaacaacaacgtgtttgtattgccagaacccttgctaccaagcctaaaattatccttctagatgagccaacctctgcacttgacccaatttctgctggtaaaattgaagagactttacatggtctaaaagatcaatataccatgttacttgttacacgttctatgcagcaagcctcacgtatttctgatcgtacaggtttcttcttagacggtaacttaattgaatatggcaatacaaaagaaatgtttatgaatcctaaacataaagaaactgaagattacattacaggtaaattcggt

SEQ ID NO: 9816 - protein, 185 aa, Streptococcus agalactiae
MYNGHNVYSPRTDTVELRKEIGMVFQQPNPFPMSVFENVVYGLRLKGIKDKATLDEAVETSLKGASIWDEVKDRLHDSALGLSGGQQQRVCIARTLATKPKIILLDEPTSALDPISAGKIEETLHGLKDQYTMLLVTRSMQQASRISDRTGFFLDGNLIEYGNTKEMFMNPKHKETEDYITGKFG

SEQ ID NO: 9817 - DNA, 843 bp, Streptococcus agalactiae
atgacatcacacgatgctgtattcaagcttcgaaagatattacatacaaaaaaaataggacacggcggaactcttgatccagatgttgttggggttttaccaattgcggttggaaaagccactcgtgttattgaatatatgacagaaagtggcaaaatttatgaaggagaaatcactttaggatatgccacaagtacagaagattctagtggagaggtcatttcaagaactccactaactcaatccgatcttagcgaggatgttgtggatcatgcgatgaaaagttttaccggtccaattacacaagttcctcctatgtattcagcagttaaagtaaatggtaaaaaactctatgaatatgctcgttcaggagaagaagtagagcgacctaaacgacaaataacaatttctgaatttagacgcacaagcccattgtacttcgaaaaaggcatctgccgttttagtttctatgtctcatgcagtaaaggtacctatgttaggacgttagctgttgatctaggaataaaactaggatatgctagccatatgtctttcctaaaaagaacctcatctgcaggattatctattacacaatcattaacgcttgaagaaattaatgaaaaatataagcaagaagatttttcatttttacttccaattgaatatggtgttttagatctcccaaaagttaacctaactgaggaagataaagttgaaatctcatacggacgtcgtatcttattagaaaatgaagcagataccttagcagctttttatgaaaatagagttatcgctatactagaaaaacgtggcaatgaatttaaaccacacaaagtattgtta

SEQ ID NO: 9818 - protein, 281 aa, Streptococcus agalactiae
MTSHDAVFKLRKILHTKKIGHGGTLDPDVVGVLPIAVGKATRVIEYMTESGKIYEGEITLGYATSTEDSSGEVISRTPLTQSDLSEDVVDHAMKSFTGPITQVPPMYSAVKVNGKKLYEYARSGEEVERPKRQITISEFRRTSPLYFEKGICRFSFYVSCSKGTYVRTLAVDLGIKLGYASHMSFLKRTSSAGLSITQSLTLEEINEKYKQEDFSFLLPIEYGVLDLPKVNLTEEDKVEISYGRRILLENEADTLAAFYENRVIAILEKRGNEFKPHKVLL

SEQ ID NO: 9819 - DNA, 429 bp, Streptococcus agalactiae
atgaagattagaactgctacactagacgatagtgaaaaattagtccctttgtatcaagaattaggatacgcaatatcattatcagagattcaatctattttaaaggttattcttactcattcagattatggctttttgatagctgaggataatggcaaactcctcgccttcgttggatatcataaactttacttttttgaaaaaagtgggacttactatcgtattttagcactagtagttaatgaaaagcaccgtcgtaaaggcatcgctagtcaacttattaatcacgttaaacagctagctaaaacagatggaagtgaagtactggctttaaatagcagtttaaaagaatatcgtcaggaagcttatcatttttatgaaaacctagggttcaagaaggttagtacaggcttttcatactatttagat

SEQ ID NO: 9820 - protein, 143 aa, Streptococcus agalactiae
MKIRTATLDDSEKLVPLYQELGYAISLSEIQSILKVILTHSDYGFLIAEDNGKLLAFVGYHKLYFFEKSGTYYRILALVVNEKHRRKGIASQLINHVKQLAKTDGSEVLALNSSLKEYRQEAYHFYENLGFKKVSTGFSYYLD

SEQ ID NO: 9821 - DNA, 2118 bp, Streptococcus agalactiae
atggcaactacgacaaaaacgtcgaccaaaaaaacaagtaaaaaaaaatcagctactgctaaaaaaaatctagttattgtggagtctcctgcaaaagcaaagactatcgaaaaatacttaggacgtaactataaagttgtagcctcagtaggtcatatccgtgatttaaaaaagtcaagtatgtccattgattttgagaataattacgaaccacaatatattaatattcgtggtaaaggacctctcattaatgatttaaaaaaagaagctaaaaaggctaaaaaagtttacctcgcgagtgacccggaccgtgaaggagaagctatttcctggcatttagcgcatattttagatttagacaaagaagacagaaaccgtgttgttttcaatgaaatcacaaaagatgctgttaaaaatgcttttgtggaacctcgtcagattaacatggatctcgttgatgctcagcaagcacgacgtgttttagatcgcattgttggttattctatctcacctattttatggaaaaaagtaaaaaaaggcctatcagctggacgtgtacaatcagttgctcttaaactaatcattgatcgtgaaaatgagattaaggctttccaaccggaggagtattggactattgacggttcctttaaaaaaggaacacgtaaattcaatgccactttctacggtttagacggaaagaaattcaaattatcgaataatgaagacgtcaaaacagttctaaaacgtattaaaactgatgaattcttagttgaaaaagttgaaaaaaaagagcgtcgtcgtaatgcaccattaccgtatacaacttcttcattgcaacaagatgcagctaataaaatcaattttcgaactcgtaaaaccatgatgattgcgcaacagctgtacgaaggacttagcttaggcacagcaggtcatcaaggtctgattacctatatgcgtactgattctacacgtattagtccgttagcacaaaatgaagcaacagaatttattactaaccgttttggtgcaaattattctaaacatgggaataaagttaaaaatgcttctggagcacaagacgctcacgaagctattcgcccatctagtgttaatcatacacccgaaagtattgctaagtatttagacaaagatcaactaaaactttacactcttatctggaaccgttttattgcaagccaaatgacagcagcagtctttgacacaatgaaagttaatttaacgcaaaatggtgttacttttattgctaatggtagccaagtcaagtttgatggttacatggctgtttataacgatactgacaaaaataaaatgttaccagatatggaggaaggagaaagtgttaaaaaggttaatacgaatcctgaacaacacttcactcaacctcctgcaaggttttcagaagcaagtctcattaaaacacttgaagaaaacggtgtaggtcgtccttcaacttatgccccaacgcttgagactattcaaaaacgttattatgttaagcttgcagctaaacgcttcgaaccaactgaacttggtgaaattgttaatagccttattgtagaatttttcccagatattgttgatgttaccttcactgccgaaatggaagggaaactagacgaagttgagattggtaaagagcagtggcaaaagattatcgatgaattttataaaccatttgaaaaagaacttgcaaaagcagaaactgaaatggagaaaattcaaataaaggatgaacctgctggatttgattgcgagctatgtggatcaccaatggtaataaaactaggacgttatggaaagttttatgcgtgtagcaatttccctgaatgtcataacacaaaagctatcactaaggaaataggtgttatttgtcctatctgtcaaaaaggacaagttattgagcgaaaaacaaaacgcaatcgtatcttttatggctgtgaccgctacccagaatgtgagtttacatcttgggacaaacctattggacgaacttgccccaaatcaaatgatttcttagtggagaaaaaagtacgcggtggtggtaaacaagttgtttgctcaaatgaaaaatgcgactaccaagaagagaaaattaaa

SEQ ID NO: 9822 - protein, 706 aa, Streptococcus agalactiae
MATTTKTSTKKTSKKKSATAKKNLVIVESPAKAKTIEKYLGRNYKVVASVGHIRDLKKSSMSIDFENNYEPQYINIRGKGPLINDLKKEAKKAKKVYLASDPDREGEAISWHLAHILDLDKEDRNRVVFNEITKDAVKNAFVEPRQINMDLVDAQQARRVLDRIVGYSISPILWKKVKKGLSAGRVQSVALKLIIDRENEIKAFQPEEYWTIDGSFKKGTRKFNATFYGLDGKKFKLSNNEDVKTVLKRIKTDEFLVEKVEKKERRRNAPLPYTTSSLQQDAANKINFRTRKTMMIAQQLYEGLSLGTAGHQGLITYMRTDSTRISPLAQNEATEFITNRFGANYSKHGNKVKNASGAQDAHEAIRPSSVNHTPESIAKYLDKDQLKLYTLIWNRFIASQMTAAVFDTMKVNLTQNGVTFIANGSQVKFDGYMAVYNDTDKNKMLPDMEEGESVKKVNTNPEQHFTQPPARFSEASLIKTLEENGVGRPSTYAPTLETIQKRYYVKLAAKRFEPTELGEIVNSLIVEFFPDIVDVTFTAEMEGKLDEVEIGKEQWQKIIDEFYKPFEKELAKAETEMEKIQIKDEPAGFDCELCGSPMVIKLGRYGKFYACSNFPECHNTKAITKEIGVICPICQKGQVIERKTKRNRIFYGCDRYPECEFTSWDKPIGRTCPKSNDFLVEKKVRGGGKQVVCSNEKCDYQEEKIK

SEQ ID NO: 9823 - DNA, 759 bp, Streptococcus agalactiae
atggcaacaattaaagaaatcaaagcaattttagagactattgttgatttaaaagacaaacgttggcaagaatatcaaacagattcacgcgcaggtgttcaaaaagcaatccttcaacgaaaaaaaaatattcagtcagatttagacgaagaagcgcgcttagaacaaatgttggtctacgaaaaaaaactttacattgaacatataaaccttattgcaggaatcgatgaagtaggtagaggtcctttagcgggaccagtagtagctgctgctgttattcttccaccaaactgtaaaataaaacatctcaatgactccaaaaaaattccaaagaaaaagcatcaagaaatctatcaaaatattttagatcaagcgttagcagttggtattggtattcaagacagccaatgtattgatgatatcaacatttatgaagctacaaaacatgctatgattgatgcagtttctcatttatctgtggctcctgaacatcttttaattgatgctatggttttagatctatcaattccacaaactaaaattatcaaaggtgatgctaattcactctctattgcagcagcttcaatcgtagctaaagtgaccagagataaaataatgtctgattatgatagcacatatcctggatatgcattttctaaaaatgctggctatggtactaaagagcatttagaaggtttgcaaaaatacggtattactccgatacatcgtaaaagttttgaacctataaaatcaatgttg

SEQ ID NO: 9824 - protein, 253 aa, Streptococcus agalactiae
MATIKEIKAILETIVDLKDKRWQEYQTDSRAGVQKAILQRKKNIQSDLDEEARLEQMLVYEKKLYIEHINLIAGIDEVGRGPLAGPVVAAAVILPPNCKIKHLNDSKKIPKKKHQEIYQNILDQALAVGIGIQDSQCIDDINIYEATKHAMIDAVSHLSVAPEHLLIDAMVLDLSIPQTKIIKGDANSLSIAAASIVAKVTRDKIMSDYDSTYPGYAFSKNAGYGTKEHLEGLQKYGITPIHRKSFEPIKSML

SEQ ID NO: 9825 - DNA, 522 bp, Streptococcus agalactiae
atgagtatctttagcgtatattctatttttcgtggtgataaagccaaagaaaaagcaagtgtcataaaacaagcatctcaaacaagtcaaacttcaaaaaaagaggtcttacaaaagaagacttatccaaatctaaataaatattcaaatctagaaattcatgtttcatctacgaggcaaacaatgacaataacctcgaatgacaaggtcatctttaaaacgattgtttcaacaggagcaaaagagagccctaccccaaaaggaacttttgtcatagaaccggaacgaggagattttttctataacgcctcatcaaaagaaggagcctattattgggtctcctttaaagaacatggtatttatctctttcatagcgttccgactgatcaacaaggaaatgagattccagaagaagcaaagcaattaggaaaagccgcctcacatggctgtgtgcgtatgtcaagggcggatgcaaaatggttctatgaaaatattcctcaaggaacgactgttaccatcaaa

SEQ ID NO: 9826 - protein, 174 aa, Streptococcus agalactiae
MSIFSVYSIFRGDKAKEKASVIKQASQTSQTSKKEVLQKKTYPNLNKYSNLEIHVSSTRQTMTITSNDKVIFKTIVSTGAKESPTPKGTFVIEPERGDFFYNASSKEGAYYWVSFKEHGIYLFHSVPTDQQGNEIPEEAKQLGKAASHGCVRMSRADAKWFYENIPQGTTVTIK

SEQ ID NO: 9827 - DNA, 120 bp, Streptococcus agalactiae
atgtttaaaggatttaaaaaattgattattattatgggagggataagcttaatgatgattttaacagcatgtgacttagtaaaaaaaatcaccaatgggttcaagaacattgaaaatact

SEQ ID NO: 9828 - protein, 40 aa, Streptococcus agalactiae
MFKGFKKLIIIMGGISLMMILTACDLVKKITNGFKNIENT

SEQ ID NO: 9829 - DNA, 699 bp, Streptococcus agalactiae
atgttagaaaaatgccctatcattgccttagatttttctgatttggcttctgtaacaacttttttagaacattttccaaaagaagaattgctttttgtcaaaataggaatggagctttattattccgaaggtccctcaattattagatatattaaatccttaggacatcgcatttttttggatttaaaattacatgatatccctaatacagttcgatcatctatgtctgtcttagccaaattaggcattgatatgactaatgtgcatgctgcaggaggagtcgaaatgatgaaagcagctagagaaggtttggggaagggtccaatactattagcagtgacacaattaacctcgacttcacaagaacaaatgcaggtggatcaacatattaacttaagtgtagttgattcggtttgccattatgctcaaaaagctcaagaagcaggcttagatggagtagtcgcatcggctcaagagggaatgcaaatcaagaaacagactaacgaacatttcatttgcttaacgcctggtatcagacctccacaaaccaatcagttagatgatcaaaaaagaacgatgactcctgagcaagcacgtatagttggggctgattatatcgttgtgggaagacctataacgaaagcagaaaatccatatcaagcatatctagagataaaagaagaatggaatcgtattaaa

SEQ ID NO: 9830 - protein, 233 aa, Streptococcus agalactiae
MLEKCPIIALDFSDLASVTTFLEHFPKEELLFVKIGMELYYSEGPSIIRYIKSLGHRIFLDLKLHDIPNTVRSSMSVLAKLGIDMTNVHAAGGVEMMKAAREGLGKGPILLAVTQLTSTSQEQMQVDQHINLSVVDSVCHYAQKAQEAGLDGVVASAQEGMQIKKQTNEHFICLTPGIRPPQTNQLDDQKRTMTPEQARIVGADYIVVGRPITKAENPYQAYLEIKEEWNRIK

SEQ ID NO: 9831 - DNA, 1023 bp, Streptococcus agalactiae
atgattcgtcaattagaacaatcgaatttaccaatagaacaagtgaaacttttatcatcaagtcgctcagcaggtaaaattttacattttaaagatgaggctatacgtgttgaagagacaacaaaagaatcattttacgatgttgatattgccttgttttcagctggtggatctatttcagcaaagttcgctccttatgcagtaaagtctggagcagttgtagtagataacacgtcatattttcgtcagaatcctgatgttccactagttgttcctgaagtaaatgctcatgccatgattggtcataatggtatcatagcttgccccaattgttctactattcaaatgatgattgctttagagcccattcgtcaaaaatgggggatagagcgtgttatagtttccacctatcaagctgtttcgggttcaggtgcacgtgctgttgaagaaactaaggaacagttgagacaagttttaaatgataacctttcacctgatcaattaattgcaacagtcttgccatgttctagcgatcaaaaacattatcctatcgcattcaatgcattacctcaaattgatatttttactgataatgattatacgtacgaagaaatgaaaatgactttggagacaaagaaaattatggaagatgctactattaaggtttcagctacctgcgtccgtattcccgttttatcggggcattctgagtccatttatattgagacgaaagaattagcctcaatctctgaaattaaaaaggctattgcaaattttcctggtgccgtcctacaagaccttccatctcagcaaatttaccctcaagcgattaatgctgtaggccatagggagacctttgttggtcgtattcgaaaagaccttgatcaagaaaatggtgttcatatgtgggtagtttcagataatctactgaagggggcagcttggaattctgttcaaattgcagaaacattgcataagaatgggctggttaaaccagcaaaagagttaaaatttgaattaata

SEQ ID NO: 9832 - protein, 341 aa, Streptococcus agalactiae
MIRQLEQSNLPIEQVKLLSSSRSAGKILHFKDEAIRVEETTKESFYDVDIALFSAGGSISAKFAPYAVKSGAVVVDNTSYFRQNPDVPLVVPEVNAHAMIGHNGIIACPNCSTIQMMIALEPIRQKWGIERVIVSTYQAVSGSGARAVEETKEQLRQVLNDNLSPDQLIATVLPCSSDQKHYPIAFNALPQIDIFTDNDYTYEEMKMTLETKKIMEDATIKVSATCVRIPVLSGHSESIYIETKELASISEIKKAIANFPGAVLQDLPSQQIYPQAINAVGHRETFVGRIRKDLDQENGVHMWVVSDNLLKGAAWNSVQIAETLHKNGLVKPAKELKFELI

SEQ ID NO: 9833 - DNA, 834 bp, Streptococcus agalactiae
ttggaatggcaagatctagcgcagttacctgtatctatttttaaagactatgttacagatgctcaagacgcggaaaaaccttttatatggacagaagtatttttaagggagattaatcgctcaaatcaagaaattattttgcatatttggccgatgactaagacagtcattctggggatgttagatcgagaattaccacatttagaattagctaaaaaagaaatcatcagtcgtggctatgaaccagttgttcggaattttggtggtctcgcagttgtagctgatgaaggaattttaaatttttcattggttattccagatgtttttgagagaaaattgtctatctcagatgggtatcttataatggtcgattttattagaagtatattttcagatttttatcaacctattgagcactttgaagtagagacctcctattgtcctggtaagtttgatcttagtataaatggcaaaaaatttgctggcttggctcagcgccgtataaagaatggtattgcggtatcaatttaccttagcgtttgtggcgatcaaaaagggcggagtcaaatgatttcagatttttataagattggtctaggtgatacgggtagtccaattgcttatccaaatgtagatcctgaaattatggctaatctatctgatctattagattgtcctatgacagtagaagatgttattgatcgtatgttgattagccttaaacaagtaggttttaatgatcgtttactgatgattagacccgatttagttgcagagtttaatagatttcaggctaagtctatggctaataaggggatggtgagcagagatgaa

SEQ ID NO: 9834 - protein, 278 aa, Streptococcus agalactiae
MEWQDLAQLPVSIFKDYVTDAQDAEKPFIWTEVFLREINRSNQEIILHIWPMTKTVILGMLDRELPHLELAKKEIISRGYEPVVRNFGGLAVVADEGILNFSLVIPDVFERKLSISDGYLIMVDFIRSIFSDFYQPIEHFEVETSYCPGKFDLSINGKKFAGLAQRRIKNGIAVSIYLSVCGDQKGRSQMISDFYKIGLGDTGSPIAYPNVDPEIMANLSDLLDCPMTVEDVIDRMLISLKQVGFNDRLLMIRPDLVAEFNRFQAKSMANKGMVSRDE

SEQ ID NO: 9835 - DNA, 690 bp, Streptococcus agalactiae
atggctatgaaaattttgattacatcaggtggaactaccgagaaaattgataccgttaggagtatcacgaatcacgcaacaggaactttaggaaaaataattgcagaaaaatatttacgagaaggacatcaggtgacactcgtgactactaaaaatgcagtcaaaccagaatctgctaccaacttatccacatttgagattgaggacgttgactcattaataaaaaccttgaagccattagtgaaagagcatgatattttaattcatagcatggcagtgtctgactatacccccgtctacatggctgatttcgaaaaggttaaatcaagcgatcatttagatacttttttgcgcaaagataaccacgaagggaaaatatcatctgaatcagaatatcaagtcctttttctcaaaaaaacaccaaaagttatcagccttgtgaaaaaatggaatcctcaaattactctagtaggttttaaactacttgtgaacgttactaaagaaaatctttttaaagttgctcgtcatagcttaatcaaaaataaagctacgtttattttagctaatgacctcattgatattacctcaaaacatcacatagcctacctacttgaccatgataatgtgtataaagctaccaccaaagaagatattgctcaattaatttacgaaaaggtaaaaaaatatgat

SEQ ID NO: 9836 - protein, 230 aa, Streptococcus agalactiae
MAMKILITSGGTTEKIDTVRSITNHATGTLGKIIAEKYLREGHQVTLVTTKNAVKPESATNLSTFEIEDVDSLIKTLKPLVKEHDILIHSMAVSDYTPVYMADFEKVKSSDHLDTFLRKDNHEGKISSESEYQVLFLKKTPKVISLVKKWNPQITLVGFKLLVNVTKENLFKVARHSLIKNKATFILANDLIDITSKHHIAYLLDHDNVYKATTKEDIAQLIYEKVKKYD

SEQ ID NO: 9837 - DNA, 975 bp, Streptococcus agalactiae
atgatggatttttatatcaaacagattattatacatcagttttctcctaacgacacagagttagtgctatcagatactccgctaaccctaactccaaggattgatgactactttcgtaaaaaattaagtaaagttttttctgatgaagctaagcgtggctattttggagaggataatgtatttatgagtcatttacaagatgatttatatgtttcttcctgtcaaattgcgcaactttggaaagaagagtttgtcatatcggaagatcaaaaaacgaatgacttagtttttattcaatttgacaaggatggaatggaacattttgctttccttcgaatctcattaaaggaacaatttgctcatgtttctgaaaatcaagagcagccaattacaataacacagaataaccttccaagtgctgctcaaactccagatgaagctttggttgttaacaagtcatcaaagcaatactatttaattgaaaagcgtatcaaacacaatggttcatttgctaattatttttctgaaaatttattacaagtacaaccagaacagtctgttaaaaaatctataaaaatggttgaacagacagctcaaaaaattgctgaaaatttcaacaaagatgatttttctttccaatcaaaaatgaaatcggctatttataagaatttagaagaagagcaagaattgtctccagaaaaattagcagatcaattatttgatgataatttaacagccaggctgacttttgttgatgaattgaaagacgcaatacctggacctgttcaagtaagtgatattgatcattcccgtcaaattaagaagttagagaatcagaagctatctctttcaaatggtattgaattgattgtacccaacaatgtctaccaagatgccgaatcagttgaatttatccaaaaccctgatggtacatactcaatactaatcaaaaacatacaggatattcaaaataaa

SEQ ID NO: 9838 - protein, 325 aa, Streptococcus agalactiae
MMDFYIKQIIIHQFSPNDTELVLSDTPLTLTPRIDDYFRKKLSKVFSDEAKRGYFGEDNVFMSHLQDDLYVSSCQIAQLWKEEFVISEDQKTNDLVFIQFDKDGMEHFAFLRISLKEQFAHVSENQEQPITITQNNLPSAAQTPDEALVVNKSSKQYYLIEKRIKHNGSFANYFSENLLQVQPEQSVKKSIKMVEQTAQKIAENFNKDDFSFQSKMKSAIYKNLEEEQELSPEKLADQLFDDNLTARLTFVDELKDAIPGPVQVSDIDHSRQIKKLENQKLSLSNGIELIVPNNVYQDAESVEFIQNPDGTYSILIKNIQDIQNK

SEQ ID NO: 9839 - DNA, 549 bp, Streptococcus agalactiae
atgccaacagaaacagtctacggaatttttgccaaagctttgagtgaagaagctgtgaaccacgtctatgagcttaaaaaaaggcctcgtgataaggctatgaacttaaatatatgtgattttgagactattttaaaatattctaaaaatcaaccgacctatttaaagcaattgtacgatgcttttttaccaggaccgctaaccattattttggaagcttcacaagaagttccgcattggatcaattctgggttattaagcgtaggatttcggatgcctaaacaccctgtaacccttgatatgattgctaaccatggtccactgattggtccttctgctaatatttctggatgtgatagtggtcgtgtgttctcagaaattcaaaaacagtttaatcatcaagttttaggtattgaagatgataaagcattgacaggtgtggattctactattattgatttgtctggtgatagagttaagattttaaggcaaggtgcaatcacgcaagaggtactaacggctacgatacctgaattaatttttgaaaat

SEQ ID NO: 9840 - protein, 183 aa, Streptococcus agalactiae
MPTETVYGIFAKALSEEAVNHVYELKKRPRDKAMNLNICDFETILKYSKNQPTYLKQLYDAFLPGPLTIILEASQEVPHWINSGLLSVGFRMPKHPVTLDMIANHGPLIGPSANISGCDSGRVFSEIQKQFNHQVLGIEDDKALTGVDSTIIDLSGDRVKILRQGAITQEVLTATIPELIFEN

SEQ ID NO: 9841 - DNA, 471 bp, Streptococcus agalactiae
gtggttattatgacaagcgccttggacactcgagatgaatttggagtcgtttcaagtcgtattggaatgcgtcgtgaagcagttccaatttcagatgatatggacattttctcctatattcagaatttaccacaaaagccttattgtgttttaattgatgaatgtcaatttttgagtaagaaaaacgtctacgatttagctagagtagtagatgacttagatgtaccagtcatggcttttggtttgaaaaatgatttccaaaacaatctttttgaaggttcaaaacatttgctattattggccgataagattgatgaaatcaaaacaatttgccaatactgtagtaagaaagcaaccatggttttaaggacagaaaacggaaaacctgtctatgaaggtgatcagatacaaattggtggtaatgaaacatatatcccagtttgtcgaaaacattattttaatccagatatt

SEQ ID NO: 9842 - protein, 157 aa, Streptococcus agalactiae
MVIMTSALDTRDEFGVVSSRIGMRREAVPISDDMDIFSYIQNLPQKPYCVLIDECQFLSKKNVYDLARVVDDLDVPVMAFGLKNDFQNNLFEGSKHLLLLADKIDEIKTICQYCSKKATMVLRTENGKPVYEGDQIQIGGNETYIPVCRKHYFNPDI

SEQ ID NO: 9843 - DNA, 936 bp, Streptococcus agalactiae
ttgcaactttctcatagtttaagactcatgggaacgactatcgatattcaaattaattctaaaaatgctcaaaaacaaatccgagaggtcatagaactcttggagctctacaaaaatcgctttagtgcaaatgactttaattcagagttaatggctataaataacaacgctggtatcaagcctattcaagtacatccagacctctttgaattaatcacaattgggaaagaacacagcttagctaggcctagtaacctaaatattgctattggtcctttagtgcaaacttggagaattggattttcagatgctaaactacctagccctagtgaaatatcagaagctatgattttatctgacccaactcatatacttctagattcaaataaacaatctgtttttttaaatcagataggaatgaaaattgatttgggtgcacttgcaaaaggatatatcgctgacaaaattatgacctatctcaaaaatgagatgattgattctgctattattaatttaggcggaaacgttttagttcacggagataatcctaatcgttcagaagggtattgggttatcggcattcaacatccgaaaaagaaacggggaaaaaatattggaactgtcaaaattaaaaaccaatctgttgtaacctcaggtacttatgaacgccgtctgattattgacgataaggaataccatcatatttttgatcgacagactggttatccgatacaaacagagatggctagcatttctattgtttctaaacaatccgtcgactgtgaaatctggaccacaaggttgttcggcttatccattaaagaggctcttgatattttaaacgctgtttcctacattgaaggcattatcatcactaaagatgatcgtatctatttatctgatggcttaaaacatcattttcaactattttatcat

SEQ ID NO: 9844 - protein, 312 aa, Streptococcus agalactiae
MQLSHSLRLMGTTIDIQINSKNAQKQIREVIELLELYKNRFSANDFNSELMAINNNAGIKPIQVHPDLFELITIGKEHSLARPSNLNIAIGPLVQTWRIGFSDAKLPSPSEISEAMILSDPTHILLDSNKQSVFLNQIGMKIDLGALAKGYIADKIMTYLKNEMIDSAIINLGGNVLVHGDNPNRSEGYWVIGIQHPKKKRGKNIGTVKIKNQSVVTSGTYERRLIIDDKEYHHIFDRQTGYPIQTEMASISIVSKQSVDCEIWTTRLFGLSIKEALDILNAVSYIEGIIITKDDRIYLSDGLKHHFQLFYH

SEQ ID NO: 9845 - DNA, 663 bp, Streptococcus agalactiae
atgcttttgtcagccttccacatgtacgaaaaacaactggataaagtaaggtttgtcggtgttcatacaggacatttagggttttatacagactatcgagattttgaagttgacacattaattaataatttgaaaaatgataaaggtgaacaaatctcctatcccattttgaaagtaactattacccttgaagatggtcgagttattcgtgcgcgtgctttaaatgagtctactattaagcgtattgaaaaaacaatggtagcggatgttgttattaatcaagtggtatttgaaaggtttaggggagatggcattttagtttctacaccaaccggtagtactgcttacaataaatcactagggggggcagtactccacccaacgatagaagccttgcaactaacagaaatttctagtcttaataatcgcgtctatcgtaccttggggtcatcggttatcatccccaaaaaagatgctatagagatagttcctaaacgagttggtgtctatacaatttctatagataacaaaacagtccattacaagaatgttaccaaaatagaatatagtattgacgaaaaaagtattaactttgtttcaactccaagtcacactagtttttgggaacgtgttaacgatgcttttatcggagaacctgaacat

SEQ ID NO: 9846 - protein, 221 aa, Streptococcus agalactiae
MLLSAFHMYEKQLDKVRFVGVHTGHLGFYTDYRDFEVDTLINNLKNDKGEQISYPILKVTITLEDGRVIRARALNESTIKRIEKTMVADVVINQVVFERFRGDGILVSTPTGSTAYNKSLGGAVLHPTIEALQLTEISSLNNRVYRTLGSSVIIPKKDAIEIVPKRVGVYTISIDNKTVHYKNVTKIEYSIDEKSINFVSTPSHTSFWERVNDAFIGEPEH

SEQ ID NO: 9847 - DNA, 678 bp, Streptococcus agalactiae
atgtaccatattgaattaaaaaaggaagctttattaccaagagaacgcctagttgatttaggcgcagatagattgagtaatcaggagttattagccattctcttacgtacaggtattaaagaaaaacctgttctggaaatttcaacgcaaattttagaaaacataagcagtttagcagattttggtcaattatccttacaggagttgcaatccattaaaggaatcggtcaggttaaatccgtcgaaataaaagctatgctagaactagcaaaacggattcacaaagctgaatatgatcgtaaagagcaaattttaagtagtgaacaattagcgaggaaaatgatgctcgaattaggggataaaaaacaagaacatttagtagctatttatatggatacacaaaatcgtattatcgaacagagaactatttttattggtactgtacgtcgttcagtagcagagccaagagaaattctacattatgcttgtaaaaacatggcaacttctttgattatcatacataatcatccctcaggttctccaaagcccagtgaaagtgatttaagtttcactaaaaaaataaaacgatcatgtgatcatctgggaattgtctgcctagatcacatcatcgttggaaaaaataaatattatagttttcgagaagaagcagatatttta

SEQ ID NO: 9848 - protein, 226 aa, Streptococcus agalactiae
MYHIELKKEALLPRERLVDLGADRLSNQELLAILLRTGIKEKPVLEISTQILENISSLADFGQLSLQELQSIKGIGQVKSVEIKAMLELAKRIHKAEYDRKEQILSSEQLARKMMLELGDKKQEHLVAIYMDTQNRIIEQRTIFIGTVRRSVAEPREILHYACKNMATSLIIIHNHPSGSPKPSESDLSFTKKIKRSCDHLGIVCLDHIIVGKNKYYSFREEADIL

SEQ ID NO: 9849 - DNA, 1434 bp, Streptococcus agalactiae
atggtaaaacaagtatttccaaaaggttttttatggggcggggcaactgctgccaatcaatgcgaaggagcttacaatgttgatggacgtggcctagcaaatgtagatgttgttcctactggagaagatcgatttgcaattatttcaggacaaaagaaaatgtttgattttgaggaaggatacttttatccagcaaaagaatcaatagatttttatcaccattataaagaggaccttgcattacttgcagaaatgggtttcaaaacctatcgtatgtcaatagcatggacgcgtatttttccaaagggtgatgagctatatccaaatgaagctggtcttcagttttatgaaaatatttttaaagagtgtcgtaagtatggtattgaacctttggtaaccattacacattttgactgtcctatctaccttattaaacattacggtgggtggcggagccgtaaaatgattggtttttatgagcgccttgtacgagctttatttactcgttttaaggggttagttaaatattggttgacctttaacgaaatcaatatgattttacacgctccttttatgggcgctggcttatattttgaagatggtgaaaatcaagagcaaattaaatatcaagcagctcaccatgagttagtggcttcggctattgcagtaaaaattgctcatgaagttgatccaaataatcaaatcggatgtatgctagctgcaggtcaatactatccaaatacgtgtcatccacaagattattgggcttcgatgcaaaaaaatagagaaaattatttttttattgatgtgcaagctcgtggcaaataccctaattatgctaaaaaacattttgagcatttaggtatttcaattcaaatgacagcagaagatcttgctttgttaagagactatacggttgattttatttcattttcttactattcaagccgagtagcttcaggtaatccaactgtcagtgaacaggttcaagaaaatattttcgcatctcttaagaatccttacttgaaatcttctgaatggggatggcaaattgatccgcttggattacgtattaccttaaatgctatctgggatcgttatcaaaaaccgatgtttattgttgaaaatggacttggagcagtagatattcctgatgagaatggttacgtagaagatgattatcgtattgattacctccgtcagcacattgctgcaatgagagatgctatatatgtagatggtgttaatctaattggctatactacatggggatgtattgatttagtatctgcaggaactggtgaaatggaaaaacgctatggtttcatttatgttgatcgcaataataaaggagaggggacactcaagcgttacaagaaaaaatcgttttattggtacaagaaggttattgcaagtaatggcagtcaaatagaa

SEQ ID NO: 9850 - protein, 478 aa, Streptococcus agalactiae
MVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLQFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQARGKYPNYAKKHFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 9851 - DNA, 795 bp, Streptococcus agalactiae
atggatggaacttttctacgctcagataaaacttatgataaagcacggttttcttctttattaacgttgatggagaagtatgatattaaatttgtagctgctagtggtaatttatacgatcaattgttgttaaactttttggaataccctaatcgtatcgcctacgtcgctgaaaatggtggtcgtgtcattgaccaagatggcacattactaaaagaaacttatttatctaatgatacagttgcagctgttttatcctatttatatcagaactatcctgagacactcatcagcttatctggtgaaaaacgttcataccttgagcgaagaactcctattaataggcggactgaattagaatactatatgcctaattttatctataaagaccatttgctgcccttagatgatgaccgctattttcaaatgacactttgggtaaatgaaaatcttgtttctgagatgttgttagatattagtgaacactttaaaaatcatcatatcagattgacctctagtggttttggttgtatcgatgtcttaccagctgatgtcaataaagcggatggtatcgctattctccttgaaaagtggggattgaaacaggatcaagtgatggtttttggtgatgggggcaatgatgtggaaatgttgagagcagcaaatatttcttacgctatgtcaaatgcgccagaagaaattaaagctattgctaaatatcaaacagttagtaacgatcaagatggtgtgttagaaacgatagagaactttcttcacaagatgagtgataatgaa

SEQ ID NO: 9852 - protein, 265 aa, Streptococcus agalactiae
MDGTFLRSDKTYDKARFSSLLTLMEKYDIKFVAASGNLYDQLLLNFLEYPNRIAYVAENGGRVIDQDGTLLKETYLSNDTVAAVLSYLYQNYPETLISLSGEKRSYLERRTPINRRTELEYYMPNFIYKDHLLPLDDDRYFQMTLWVNENLVSEMLLDISEHFKNHHIRLTSSGFGCIDVLPADVNKADGIAILLEKWGLKQDQVMVFGDGGNDVEMLRAANISYAMSNAPEEIKAIAKYQTVSNDQDGVLETIENFLHKMSDNE

SEQ ID NO: 9853 - DNA, 792 bp, Streptococcus agalactiae
atgaagaaaacctctagtctattttcaattccttatatggcttggttattcttatttgtattagcacctgttgctttgattgcttggaactcgttctttgatattaatgggcactttactttagctaattaccagacgttttttagctcaggaacctatcttaaaatgagctttaactcggtcctatatgcaggcatcgttagtttcataacgcttttgattagctatccagctgcttatttgcttacaaaattaaaacacaagcaattatggctaatgctagttattttgccaacatggattaatcttttgttaaaagcctatgcttttatggggatatttggtcaacaagggggaattaacgccttcttaacctttataggtatcggcccaaaacagattctatttacagacttttcatttctttttgtagcagcttacattgaattaccgtttatgttattacccatttttaatgccttggatgatattgatcaaaatctcatttatgcaagtgatgacttgggtgcaaatgcatggcaaacttttcagaaggttatatttcctttatctctgaatggtgtaagagcaggtgtacagtctgtctttatccctagtttgagtctctttatgcttacgcgtcttattggtggtaatcgagttatcactttagggacagccatagaacaacattttttaatcacacaaaataaaggtatgggctcaaccataggggttattttaattttagtgatggttgctattatgtggttaacaaaggagaggaaagca

SEQ ID NO: 9854 - protein, 264 aa, Streptococcus agalactiae
MKKTSSLFSIPYMAWLFLFVLAPVALIAWNSFFDINGHFTLANYQTFFSSGTYLKMSFNSVLYAGIVSFITLLISYPAAYLLTKLKHKQLWLMLVILPTWINLLLKAYAFMGIFGQQGGINAFLTFIGIGPKQILFTDFSFLFVAAYIELPFMLLPIFNALDDIDQNLIYASDDLGANAWQTFQKVIFPLSLNGVRAGVQSVFIPSLSLFMLTRLIGGNRVITLGTAIEQHFLITQNKGMGSTIGVILILVMVAIMWLTKERKA

SEQ ID NO: 9855 - DNA, 1179 bp, Streptococcus agalactiae
atgctagagcagctgggaaaccctcaaaacaacctatctgccattcatgttgttggaacgaatggtaaaggatcaacaactagttatttacaacatatttttaccaattctggttatcaagttggaacatttacatcaccatatattgttgactttagagagcgtattagcattgatggtcaaatgattccagagtctgattttatcaaacttgttgaaactgttcgtccagttgttgaacggttgcaccttgagaccaacctagaaccagctacagaatttgaagttataacagttttgatgttctattattttggcaatagctgtccggttgatatcgtcattattgaggctggaatgggcggttattatgattctaccaacatgttcaaggctttagcggttacttgtccgtcaattggattagatcatcaggaggttttaggacgaacttatgtagatatagctgagcaaaaagtaggtgttttaaaaaaaggagttccattcgtatatgctaatgatcgtcaggatgttgaagaagtctttcaaataaaagccaaggaaacccacagccagacttatcgtttacacaatgacttttatataaaagaagaggaaaattattttaactatataggtcctcaagcaaatattgatcatattcagttgcaaatgccgggacatcaccaagtttccaatgctagcatagctataactaccagtttattattaagagacaaatatccaaagttaaccctacagaccattaaagatgggcttgaaatgacaaaatgggtaggccgtacagaattaatctttccgaatgtaatgattgatggcgctcataataatgaaagtgtcgatgctctcgttcaagttataaaaaaatatcagcagaaaaacgtgcatattctatttgctgcaattaatactaaaccgatagagagtatgttagaatcattgtctagtatcgctccggtttcggttactagctttgattaccctaaatcaataaacttagacaaatatcctaaagcgtacactagagttagtgattggaagaaatggctacatgatataaatctgacatcagataaagatttctatgtgattactggctccctttattttatttctcaagttcgtcaggagctactattaatcaaaactacaacaact

SEQ ID NO: 9856 - protein, 393 aa, Streptococcus agalactiae
MLEQLGNPQNNLSAIHVVGTNGKGSTTSYLQHIFTNSGYQVGTFTSPYIVDFRERISIDGQMIPESDFIKLVETVRPVVERLHLETNLEPATEFEVITVLMFYYFGNSCPVDIVIIEAGMGGYYDSTNMFKALAVTCPSIGLDHQEVLGRTYVDIAEQKVGVLKKGVPFVYANDRQDVEEVFQIKAKETHSQTYRLHNDFYIKEEENYFNYIGPQANIDHIQLQMPGHHQVSNASIAITTSLLLRDKYPKLTLQTIKDGLEMTKWVGRTELIFPNVMIDGAHNNESVDALVQVIKKYQQKNVHILFAAINTKPIESMLESLSSIAPVSVTSFDYPKSINLDKYPKAYTRVSDWKKWLHDINLTSDKDFYVITGSLYFISQVRQELLLIKTTTT

SEQ ID NO: 9857 - DNA, 1281 bp, Streptococcus agalactiae
atgactattaaaatagctttattaggttttggaacggttgctaagggtattccatatttgctaaaagaaaatcaacataagctactttctttagaaggcgaagatattgtgattgataaagtattagtaagagataatgaaagccgccagcgtttcatcaatcagggatttacttataactttgtgacagagataaatactattcttcaagattcacaaattgatattgtagtggaattaatgggggggattgagccagctaaaacttatttgagtcaagcattaggatttggtaaacatattgtgacagccaataaagatctcattgctttacacggaaaagagttgatggatttagcagacgctagaggtctagctttattctatgagggagcagttgctggaggcattcctattttaaggaccctatcgcattcgtttgcctcagataaaatgacacgtttattaggaattctcaacggtacctccaacttcatgttaacaaaaatgtttgaagagggatggtcttatgaacaagctctaaaaaaggcacaagagttaggttatgctgaaagtgatcccacaaatgatgttgaaggtattgatactgcctacaaagccactatcttaagtcaatttggatttggtatgcctattgattttgatgatgttaattataaggggatttctagtattcgctcagaggatgttgaagtagctcaggagatgggctttgccattaagttggtagctgatcttcgtgaaactccaactggtataagtgtagacgtttctccgacactaatttctcaaaagcatcccttagctgcagttaatcatgtgatgaatgcagtattcattgaatcaatagggattggtcagtctcttttttatggaccaggtgcgggacaaaatccaacagcaacctctgttttagcggatatcatcgatattagtcgtagtattcgatcacagataaaaattaagcctatgaatacttatcattgtccgtgtaggttgtcaatgcagtctgatattttcaatgagtactatctagctatttctttgagaaatgctgaagatagtgatacacttggaaggtactttgagcaagaaaatataggtttgaaaaatgttatcgaaaaagcattgggtgataaacaacaagaaatctatgtattaacagatgaagttagccaagagaaaataactcaatttattgaggagtttcctgagagtggtgtcattcagttaatcaatgttttcaaagtaataggaggg

SEQ ID NO: 9858 - protein, 427 aa, Streptococcus agalactiae
MTIKIALLGFGTVAKGIPYLLKENQHKLLSLEGEDIVIDKVLVRDNESRQRFINQGFTYNFVTEINTILQDSQIDIVVELMGGIEPAKTYLSQALGFGKHIVTANKDLIALHGKELMDLADARGLALFYEGAVAGGIPILRTLSHSFASDKMTRLLGILNGTSNFMLTKMFEEGWSYEQALKKAQELGYAESDPTNDVEGIDTAYKATILSQFGFGMPIDFDDVNYKGISSIRSEDVEVAQEMGFAIKLVADLRETPTGISVDVSPTLISQKHPLAAVNHVMNAVFIESIGIGQSLFYGPGAGQNPTATSVLADIIDISRSIRSQIKIKPMNTYHCPCRLSMQSDIFNEYYLAISLRNAEDSDTLGRYFEQENIGLKNVIEKALGDKQQEIYVLTDEVSQEKITQFIEEFPESGVIQLINVFKVIGG

SEQ ID NO: 9859 - DNA, 1374 bp, Streptococcus agalactiae
atggcatataaaacaatttatccgtacactaacgaagtattgcatgaattcgataatatcagtgacagtgatctcgaacagtcattagacatagcgcatgccctctacaagacatggcgcaaagaagataatgttgaagaacgccaaaatcaattgcataaagtagcagatttattacgtaaggatcgtgataagtacgctgaagttatgactaaagatatgggaaaacttttcactgaagcacaaggagaagtggacttgtgtgcagacatagctgactattatgctgataatgggcaaaagtttttaaaacctgttccgttagaaagtccaaatggagaggcttactatttgaagcaagctgtcggtgttttacttgctgtcgagccatggaatttcccattttatcagattatgcgtgtatttgcccctaactttatagtgggtaatactatgcttttaaaacatgcttctatttgtcctgcctcagctcaagcgtttgaggatttagtccgagaagcaggagctccagaaggagcgtttaaaaatatttttgcttcgtatgatcaagtttcaaaccttatatcagatcctcgtgttgcaggtgtgtgtttaactggttctgagcgtggtggggcatcaatagcagctgaagctggtaaaaatttgaaaaaatcgtctatggaattaggtgggaacgatgcttttcttattttagatgatgctgattttgatttacttagtaaaacaatattctttgcgcgtttatataatgcaggtcaagtatgtacatcttcaaaacgtttcattgtcatggctgataagtatgacgaatttgtaaatatggtagttgagacctttaagtctgctaaatggggcgacccaatggattcggaaacaaccttggctccactgtcatctgcaggtgcaaaggatgatgttttaaaacaaattaaattggcggtagaccacggtgctgaggtagtttttggaaatgacactatagatcatccaggaaacttcgtcatgccaactgttttaacgaatatcactaaagcaaatccaatctataatcaagaaattttcggccccgtagcctctatctataaagtggatactgaagaagaagctattgctttagctaatgattctagttatggtttaggaagcactgttttttcttctgatccagaacatgctaaaaaagtggcggctcagattgaaacagggatgacatttattaattcagggtggacatcattaccggaattaccgtttggaggtattaaaaattcaggatatggtcgtgagttgagccaacttggatttgatgcctttgtcaacgaacatttggtatttacaccaaatagtgat

SEQ ID NO: 9860 - protein, 458 aa, Streptococcus agalactiae
MAYKTIYPYTNEVLHEFDNISDSDLEQSLDIAHALYKTWRKEDNVEERQNQLHKVADLLRKDRDKYAEVMTKDMGKLFTEAQGEVDLCADIADYYADNGQKFLKPVPLESPNGEAYYLKQAVGVLLAVEPWNFPFYQIMRVFAPNFIVGNTMLLKHASICPASAQAFEDLVREAGAPEGAFKNIFASYDQVSNLISDPRVAGVCLTGSERGGASIAAEAGKNLKKSSMELGGNDAFLILDDADFDLLSKTIFFARLYNAGQVCTSSKRFIVMADKYDEFVNMVVETFKSAKWGDPMDSETTLAPLSSAGAKDDVLKQIKLAVDHGAEVVFGNDTIDHPGNFVMPTVLTNITKANPIYNQEIFGPVASIYKVDTEEEAIALANDSSYGLGSTVFSSDPEHAKKVAAQIETGMTFINSGWTSLPELPFGGIKNSGYGRELSQLGFDAFVNEHLVFTPNSD

SEQ ID NO: 9861 - DNA, 1005 bp, Streptococcus agalactiae
atgttatttaaggaaaaaattcctggattaatattatgctttattattgctataccatcttggttgcttgggctttatctccctttaataggagcaccagtttttgctatcttgattggaataattgttggatccttttatcaaaatcgacaattatttaataagggtattgcttttacatctaaatatattttacaaacagcagttgtcttattaggttttggactaaacctcatgcaagtgatgaaagttggtatatcatcgttacccatcattattatgacgatttccatttcattgattattgcttatgttttgcaaaagttatttaagttagataaaacgattgctactttaataggtgttggttcatctatttgtggtgggtccgcaattgcagcgactgcaccagttattaatgctaaagatgatgaagtagcacaagctatttcggttatttttttattcaatatcttagcggctttaatttttccaacgctggggaattttattggtctctctgatcacggttttgcattatttgcagggactgctgtcaatgatacctcgtcagttacagcaactgctactgcatgggatgctatcaatcacagcaatactttgggcggagctactattgttaaattgacacgaacattagccatcattccaattacgattgtattatctatttaccatatgaaacaaacgcagaaagaacaatctgtaagtgttactaagatatttccgaagtttgtgctttattttatcttagcttctttgctaacaacgatagttgcttcattaggtttttcgttacgtatctttgagccacttaaggttttatctaaattttttattgttatggcaatgggggcaattggtataaatactaatgttagcaaactaattaaaactggaggaaaatcaattcttttaggtgcagcgtgttggttaggcattattatagttagtttaacaatgcaagctatccttggaacttgg

SEQ ID NO: 9862 - protein, 335 aa, Streptococcus agalactiae
MLFKEKIPGLILCFIIAIPSWLLGLYLPLIGAPVFAILIGIIVGSFYQNRQLFNKGIAFTSKYILQTAVVLLGFGLNLMQVMKVGISSLPIIIMTISISLIIAYVLQKLFKLDKTIATLIGVGSSICGGSAIAATAPVINAKDDEVAQAISVIFLFNILAALIFPTLGNFIGLSDHGFALFAGTAVNDTSSVTATATAWDAINHSNTLGGATIVKLTRTLAIIPITIVLSIYHMKQTQKEQSVSVTKIFPKFVLYFILASLLTTIVASLGFSLRIFEPLKVLSKFFIVMAMGAIGINTNVSKLIKTGGKSILLGAACWLGIIIVSLTMQAILGTW

SEQ ID NO: 9863 - DNA, 2277 bp, Streptococcus agalactiae
atgaatcctttaataattggaatgaatgataaacaagcagaagcggtacaaacgacagacggaccgcttttgattatggcaggagctggctctggaaaaacacgtgttctgactcatcgtattgcttatttaatagatgaaaaatatgttaatccttggaatattttagcgattacttttactaataaagcagcgcgtgaaatgcgtgaacgtgctatcgccttgaatccagctacccaagatactttgattgcaacttttcatagtatgtgtgttcgtattttacgtcgtgaagctgattatattggatataatcgtaactttacaatcgttgatccaggtgagcagcgtactttaatgaagcgaatcattaagcaattaaatttggacacaaaaaagtggaatgaacgttcaattttaggtacaatctctaatgctaaaaatgaccttcttgatgaaattgcatatgagaagcaagccggagatatgtatacacaggtaattgctaaatgctataaagcttatcaagaggaattacgtagaagtgaggccatggatttcgatgacttgattatgatgacacttcgattatttgatcagaataaagatgttttggcctattaccaacagaggtatcaatatatccatgtagacgagtatcaagatactaaccacgctcaataccaattagttaagttattagcttcgcgtttcaaaaatatttgtgttgttggtgatgccgatcaatccatttacggatggcgtggagctgatatgcaaaatattcttgattttgaaaaggactatccgcaagccaaagttgtattattagaagaaaattatcgatcgactaagaaaatacttcaagctgctaataatgtgattaatcataataaaaatcgccgtcccaaaaaattatggactcaaaatgatgaaggtgagcaaattgtatatcatagagctaacaacgagcaagaagaagcagtttttgtagcatcaactattgataacatcgttcgagaacaaggaaaaaatttcaaagattttgccgttctttatcgtacgaatgcgcaatctcgtactattgaggaagcacttttaaaatccaatattccatatacaatggttggtggaacaaaattctatagtcgtaaagaaattcgagatgttattgcttatctcaatatccttgcaaatacttctgataatatttcttttgagcggattgtaaatgaacctaaaagaggggtggggccaggaactttagaaaaaatacggtcatttgcctatgaacagagcatgtctcttcttgatgcctcttcaaatgtcatgatgtcgcccttaaaagggaaggctgctcaagctgtttgggatttagctaatctgattttgactctacgtagtaatctagatagtttaactgtaacggagattacagaaaacctactggataagacaggatatctagaagcacttcaagttcaaaatacattagaaagtcaagcgcgtattgaaaatattgaagaattcttgtcagtgactaaaaattttgacgataacccagagattacagtagagggtgaaactggtttagatcgtctatcgcgttttttaaatgatttagctttaatagcagatactgatgatagcgccactgaaacggctgaggtcactttaatgacattacatgctgccaagggtctagaatttccagttgttttcttaatcggtatggaagaaggagtatttcctttatcgcgtgcaatagaggatgctgatgaattagaagaagagcgtcgtttagcttatgtcgggattacgagagcagaacaaatacttttccttaccaatgctaatacccgtactttatttggtaaaactagttataatagaccaacccgttttatacgtgagattgatgatgaactgatacaataccaagggttagctcgaccagttaattcttcatttggtgtgaaatattcaaaagaacagcctacacaatttggtcaaggaatgagtcttcaacaagcgcttcaggcacgtaaaagtaattcacaatctcaagtaactgcccaactccaggctcttaacgcgaacaatagccatgagacatcatgggagattggtgatgttgcaactcataaaaaatggggggacggtacggtgcttgaagtttcaggtagcggaaagactcaagagttaaaaataaattttccaggtattgggttaaagaaattattagcgagtgtcgctcctattagcaaaaaggaaaac

SEQ ID NO: 9864 - protein, 759 aa, Streptococcus agalactiae
MNPLIIGMNDKQAEAVQTTDGPLLIMAGAGSGKTRVLTHRIAYLIDEKYVNPWNILAITFTNKAAREMRERAIALNPATQDTLIATFHSMCVRILRREADYIGYNRNFTIVDPGEQRTLMKRIIKQLNLDTKKWNERSILGTISNAKNDLLDEIAYEKQAGDMYTQVIAKCYKAYQEELRRSEAMDFDDLIMMTLRLFDQNKDVLAYYQQRYQYIHVDEYQDTNHAQYQLVKLLASRFKNICVVGDADQSIYGWRGADMQNILDFEKDYPQAKVVLLEENYRSTKKILQAANNVINHNKNRRPKKLWTQNDEGEQIVYHRANNEQEEAVFVASTIDNIVREQGKNFKDFAVLYRTNAQSRTIEEALLKSNIPYTMVGGTKFYSRKEIRDVIAYLNILANTSDNISFERIVNEPKRGVGPGTLEKIRSFAYEQSMSLLDASSNVMMSPLKGKAAQAVWDLANLILTLRSNLDSLTVTEITENLLDKTGYLEALQVQNTLESQARIENIEEFLSVTKNFDDNPEITVEGETGLDRLSRFLNDLALIADTDDSATETAEVTLMTLHAAKGLEFPVVFLIGMEEGVFPLSRAIEDADELEEERRLAYVGITRAEQILFLTNANTRTLFGKTSYNRPTRFIREIDDELIQYQGLARPVNSSFGVKYSKEQPTQFGQGMSLQQALQARKSNSQSQVTAQLQALNANNSHETSWEIGDVATHKKWGDGTVLEVSGSGKTQELKINFPGIGLKKLLASVAPISKKEN

SEQ ID NO: 9865 - DNA, 1323 bp, Streptococcus agalactiae
atgactttaaatgctaaaggtgaaagtaatcaaattctagtagataaggaagtacattctactaacttattactagatatcgatgaaaaaccagaattatttcaaggtttgctgttaagttttcaacatgtttttgccatgtttggagctacgatattagttccgcttattttagggatgcctgtatcagtggctttatttgcttctggttgcggaacgctcatttatcaagttgcgacaaaatttaaagtccctgtttacctaggctcatcatttgcttatattacagctatggcattagccatgaaacaaatgcatggcgatatttcggctgctcaaacaggtattctttttgtaggtctaatctatgtcgttgtggcgacggttattaagttcgtaggaaattcatgggttgataagattttgccaccaataatcattggacctatgattattgttattggtttaggtttggcaaactctgctgtaactaatgcaggttttgtcgctaaaggtgattggcgtaaaatgctagttgctgttgttacattcttgattgcagcttttatcaatactaaagggaaaggttttatcaagattattccatttttatttgcaattattggaggttatattttatcaatcattcttggcttggtagatttatctccagttgaaaaagctgcctggtttgaattgccaaaattctatttaccgtttaagacaggtttatttcacagttataaactttactttggaccagaaatgcttgccattcttccaatctcaattgtaacgattgctgaaaatatcggtgatcatacagttttaggtcagatttgtgggcgtaactttctaaaaaaaccaggtttaaatcgtcttttaattggagatggtttagcaaccgcattttctgctcttataggaggaccagctgaaactacttatggtgaaaatacaggtgttattggcatgacgcgtatagcttctgtaacggttattcgtaatgcagcttttattgcaatcgctttttcattctttggtaaatttacagctttgatctctacaattcctagtgcagtacttggtggaatggctatattactttatggtgttattgcaagtaatggattaaaagtgttgattgaaaatcgtgtcaattttgctgaggttcgtaatctgattattgctagttccatgttagttttaggcctcggtggagcagtccttgatctaggtgctctaactttatcaggaacagcattaagtgctatagtgggtattatattaaatttaatattgccaaaagaaagcatgaaatca

SEQ ID NO: 9866 - protein, 441 aa, Streptococcus agalactiae
MTLNAKGESNQILVDKEVHSTNLLLDIDEKPELFQGLLLSFQHVFAMFGATILVPLILGMPVSVALFASGCGTLIYQVATKFKVPVYLGSSFAYITAMALAMKQMHGDISAAQTGILFVGLIYVVVATVIKFVGNSWVDKILPPIIIGPMIIVIGLGLANSAVTNAGFVAKGDWRKMLVAVVTFLIAAFINTKGKGFIKIIPFLFAIIGGYILSIILGLVDLSPVEKAAWFELPKFYLPFKTGLFHSYKLYFGPEMLAILPISIVTIAENIGDHTVLGQICGRNFLKKPGLNRLLIGDGLATAFSALIGGPAETTYGENTGVIGMTRIASVTVIRNAAFIAIAFSFFGKFTALISTIPSAVLGGMAILLYGVIASNGLKVLIENRVNFAEVRNLIIASSMLVLGLGGAVLDLGALTLSGTALSAIVGIILNLILPKESMKS

SEQ ID NO: 9867 - DNA, 1344 bp, Streptococcus agalactiae
atgctaacactttttactcatatcaatagcttcgtttggggtccacctttacttgctttattagtcggaacaggtatttacctatcatttcgcttaggttttattcaattgagacaactttctagagctttcaaattgattttccgagaggataacgggcaaggagatatttcaagttatgctgcccttgcaactgctcttgctgcaacggtagggacaggtaatatcgttggtgtggctacggctattaaatctggaggaccaggagctttgttttggatgtgggtagctgccttttttggaatggcaacaaaatacgcagaaggattattagctatcaaatatcgcacaaaagatactaatggagaaatttctggaggaccgatgtactacattatcaatggaatgggacaaaaatggaaaccattagcagtctttttttctgcagcaggtatcttagtagctcttttaggaatagggacattcactcaagtcaatgcaattgcttcttctcttgagcatactttcaaaatatcaactagatttaccagcctcattcttgctgttatagtattatttattatatttggaggtataaaatctatttcaaaagtttcagaaaaaatagtgccttttatggctataagctatattttagcaactctgattattattgcagttaattacaataagattccacatactttccaactcatctttagcggtgctttttctgggacagcagccattggtggtttttctggagctatcgttaaagaagcaattcaaaagggaattgctagaggagttttctcaaatgaatctggattgggttctgctccaatagccgcagcagcagctaaaacaaaagaacctgttgaacaaggccttatttcaatgacaggaaccttcattgacactattgttatttgtactttgacagggattgcaattttagttacaggaaaatggctagaatttgatttacagggtgctccgttaacacaagcatcttttaataccgtatttggctcactaggtagttttgccctaaccttttgccttgtcttatttgcttttactactattttaggatggagctattacggagagcgttgctttgaatatctatttgggactaaatttattaacgcttatcgcattatttttgtcattatggtcggcttaggtggtttcttacagctcgatctcatttgggttatcgctgatatcgttaatggtttaatggctttacccaatctaatagctctcctagctttgtcaccaattattgttaaagaaacacagaaatatttttcagagactaaaaatatcactaagcct

SEQ ID NO: 9868 - protein, 448 aa, Streptococcus agalactiae
MLTLFTHINSFVWGPPLLALLVGTGIYLSFRLGFIQLRQLSRAFKLIFREDNGQGDISSYAALATALAATVGTGNIVGVATAIKSGGPGALFWMWVAAFFGMATKYAEGLLAIKYRTKDTNGEISGGPMYYIINGMGQKWKPLAVFFSAAGILVALLGIGTFTQVNAIASSLEHTFKISTRFTSLILAVIVLFIIFGGIKSISKVSEKIVPFMAISYILATLIIIAVNYNKIPHTFQLIFSGAFSGTAAIGGFSGAIVKEAIQKGIARGVFSNESGLGSAPIAAAAAKTKEPVEQGLISMTGTFIDTIVICTLTGIAILVTGKWLEFDLQGAPLTQASFNTVFGSLGSFALTFCLVLFAFTTILGWSYYGERCFEYLFGTKFINAYRIIFVIMVGLGGFLQLDLIWVIADIVNGLMALPNLIALLALSPIIVKETQKYFSETKNITKP

SEQ ID NO: 9869 - DNA, 705 bp, Streptococcus agalactiae
ttggaggtaaaaatggcaactttaacgaataaccctatctttggtattatgttaaccgtatgggcgtattacattggcataaggatttttagaaaatatccttcccctgcaacaactccacttcttttggcgactattttattaattgcttttttaaaattaacacatatctcctataaagattactacaatggcggttcatttctaacgatgttaattacgccttcaacggttgtattggctattcctctctatagaacctttcatttaatgaagcatcacattaaaagcattagcattagcatcatcttagcttctgttatcaacacagtttttaccgcaatagttgctaagttttttggtatgaaatatttcttagcaatctcacttttcccaaagtccgtaactacagctatggccgttggaattacaagtaaagcaggtggattagctactatcactctggtcgtagttgttattacaggcatcttaacaagcgttttgggtcctatttttctaaaattattaaggatagaagatcctgttgctatagggctcgcgctaggaggaactgggcatgctataggaactggacaagccttaaaatatggccaagttcaaggcgccatggctggactagcaattggtatcacagggatttgctatgttattgtcagtcctttagttgcaggcttaatattgaaa

SEQ ID NO: 9870 - protein, 235 aa, Streptococcus agalactiae
MEVKMATLTNNPIFGIMLTVWAYYIGIRIFRKYPSPATTPLLLATILLIAFLKLTHISYKDYYNGGSFLTMLITPSTVVLAIPLYRTFHLMKHHIKSISISIILASVINTVFTAIVAKFFGMKYFLAISLFPKSVTTAMAVGITSKAGGLATITLVVVVITGILTSVLGPIFLKLLRIEDPVAIGLALGGTGHAIGTGQALKYGQVQGAMAGLAIGITGICYVIVSPLVAGLILK

SEQ ID NO: 9871 - DNA, 1947 bp, Streptococcus agalactiae
ttggctaaacaagatataacagtgacgaattatggcgacgatgctattcaagtcttagaaggattagatgctgttcgtaagcgtccagggatgtatatcggttccacagatggaactggtttacatcatttagtgtgggaaattgtagataatgcagttgatgaagctctatcaggttttggaaatcgcattgatgttattattaacaaagatgggagtataactgttacagaccatggacgcggtatgccaactggaatgcatgctatgggaaaacctactgttgaagtcatcttcacggtgcttcatgcaggtggaaaatttggacaaggtggttataaaacatcaggtggtctccatggtgttggatcatctgtagttaatgctttgtcttcttggttagaagttgaaatcattcgcgacggagctatttacagacaacgttttgaaaatggtggtaagcccgttacaactctgaaaaaaattggcacggcaccaaaatcaaaatctggaacttctgtcagctttatgccagatcaatcagtattttcaacgatagattttaagtttaatacaattgcagagcgcttaaaggaatctgcttttctcttaaaaaatgttactttaaccttaacagataatcgttcagaagaagcagagcatctagaatttcattatgaaaacggtgttcaagattttgtagagtatttaaatgaagataaagaaacgttgacaccaatcatgtttttcgaaggtgaagaacaagaatttcatatcgaagttgctttgcagtataatgatggtttttcagataatatcctttcttttgtcaataatgttcgtactaaagatggtggaacacatgaaactggcttgaaatcagctattacaaagtctatgaatgactatgcacgtaaaacaggacttcttaaagaaaaagataaaaaccttgaaggttctgattatcgtgaggggctatcagccattttatctattcttgtacctgaggagcacttgcaatttgaaggtcaaactaaagataaactaggaagtcccttagcacgaccaattgttgatggtattgtttctgaaaagttaacttactttcttatggaaaatggagatttagcatctaatttaatccgtaaggcaataaaagcacgtgatgcgcgtgaagctgcacgtaaagcacgtgatgaaagtaggaatgggaaaaagtcgaaaaaagataaaggtctactttctggaaaattaacccctgcacaatcaaaaaatgctaagaaaaatgaactctatttagtcgaaggagactctgcaggtggctctgctaagcaaggtcgtgatagaaagtttcaagctattttaccgttgcgaggaaaagtattgaatacagctaaggcaaagatggctgatattataaaaaacgaagaaattaatacaatgatccataccattggtgcaggtgttggtcctgattttaatcttgacgatattaattatgataaaattatcattatgaccgatgctgatactgacggagctcatattcagacactattattaactttcttttatcgctatatgagacctcttgttgaagagggacatgtctatattgctttgccacctttgtataaaatgtcaaaaggaaaaggtaagaaagaaattgttgagtatgcttggacggatatagagttagaagaattacgacaaaaatttggtaaaggctcactattacaacgatataaagggcttggggaaatgaatgccgatcaattgtgggaaaccactatgaaccctgagacaaggacattaattcgtgtaacaattgaagatttagcaagagcagaacgtcgagttaatgtcttgatgggtgataaagttcctccaagacgccaatggattgaagataatgtcaagtttactttagaagagaatacagtattt

SEQ ID NO: 9872 - protein, 649 aa, Streptococcus agalactiae
MAKQDITVTNYGDDAIQVLEGLDAVRKRPGMYIGSTDGTGLHHLVWEIVDNAVDEALSGFGNRIDVIINKDGSITVTDHGRGMPTGMHAMGKPTVEVIFTVLHAGGKFGQGGYKTSGGLHGVGSSVVNALSSWLEVEIIRDGAIYRQRFENGGKPVTTLKKIGTAPKSKSGTSVSFMPDQSVFSTIDFKFNTIAERLKESAFLLKNVTLTLTDNRSEEAEHLEFHYENGVQDFVEYLNEDKETLTPIMFFEGEEQEFHIEVALQYNDGFSDNILSFVNNVRTKDGGTHETGLKSAITKSMNDYARKTGLLKEKDKNLEGSDYREGLSAILSILVPEEHLQFEGQTKDKLGSPLARPIVDGIVSEKLTYFLMENGDLASNLIRKAIKARDAREAARKARDESRNGKKSKKDKGLLSGKLTPAQSKNAKKNELYLVEGDSAGGSAKQGRDRKFQAILPLRGKVLNTAKAKMADIIKNEEINTMIHTIGAGVGPDFNLDDINYDKIIIMTDADTDGAHIQTLLLTFFYRYMRPLVEEGHVYIALPPLYKMSKGKGKKEIVEYAWTDIELEELRQKFGKGSLLQRYKGLGEMNADQLWETTMNPETRTLIRVTIEDLARAERRVNVLMGDKVPPRRQWIEDNVKFTLEENTVF

SEQ ID NO: 9873 - DNA, 621 bp, Streptococcus agalactiae
atgattatcattgcctatctgttaggctctatccaaactggactttggattggtaaatatttttaccaagtcaatcttcgtcaacacggtagtggtaatactggcaccacgaataccttccgtattttaggtgtaaaagctggcattgtcactttgactattgacattttaaaagggactctagcaacacttattcctatcatattaggtataacgacagtatctccattttttatcggtttttttgctattataggtcacactttccctatttttgcacaattcaaaggtgggaaagccgttgctacaagcgctggggttttgctaggatttgcaccttcttttttcctttacttattagttatctttttattaacgctttatctttttagcatgatttccctatccagtattacagtagctgttgtaggtattcttagtgtcttaatttttccattagtaggctttatattaacggactacgactggatatttaccactgtggttatcttaatggccctaacgattattatccgacatcaggataatatcaaacgtattcgaaaaaggcaagaaaatttggttccgtttggcttaaacctaagtaaacaaaaaaataaa

SEQ ID NO: 9874 - protein, 207 aa, Streptococcus agalactiae
MIIIAYLLGSIQTGLWIGKYFYQVNLRQHGSGNTGTTNTFRILGVKAGIVTLTIDILKGTLATLIPIILGITTVSPFFIGFFAIIGHTFPIFAQFKGGKAVATSAGVLLGFAPSFFLYLLVIFLLTLYLFSMISLSSITVAVVGILSVLIFPLVGFILTDYDWIFTTVVILMALTIIIRHQDNIKRIRKRQENLVPFGLNLSKQKNK

SEQ ID NO: 9875 - DNA, 483 bp, Streptococcus agalactiae
atgagagaaactgaaacacacgatcaccaagcgctaattcaaaaattgttagtcagtattcattatttaaccttgtttcgtgatgaaattatattagtagaaaaaaccccatctttactggggaaacatttttctattgctattgtgcagaatgaactaggtgagatactttctaaaatagaagctttgagtaagcaaaaaaaactgattcgttctatttattggtatgatgaatcgtcatttaaagttatgaataaggctctggctattgtagaagaatggattaagggcttagataatcttttagaattctgtcaatcacagacggtttttcaagcaattttaggtgatgaacgtgcacatgtatttggaatccttattgatgtttatacttctttaaacattataaatacttctttgaaagaagaaaattctagaccagtgtccttatctgatttggctctaggtcttaaggacgaagat

SEQ ID NO: 9876 - protein, 161 aa, Streptococcus agalactiae
MRETETHDHQALIQKLLVSIHYLTLFRDEIILVEKTPSLLGKHFSIAIVQNELGEILSKIEALSKQKKLIRSIYWYDESSFKVMNKALAIVEEWIKGLDNLLEFCQSQTVFQAILGDERAHVFGILIDVYTSLNIINTSLKEENSRPVSLSDLALGLKDED

SEQ ID NO: 9877 - DNA, 591 bp, Streptococcus agalactiae
atgtttgaaacacctgaagatattatcttcaaaaacttttctatagttaaacacgaagcggaaaaaagatttgaacatcttcaaatcttatatggtggagaattgtactatacaagtgatatgttagaaaaactgaagttaaagcaaattccaactttaaacaatacgaaatttgctttaattgaattttctatgcaaacttcttggaaagatattcatacagctttgtcaaatgttttaatgcttggtattacaccagtcgttgcgcatatagagaggtataacgctttagagaatcaaaaagaacgggtgaaggaaattattaatatggggtgttacacacaaataaatagttcccatattttgaaacaaaaactttttaatgataagcataaacgctttaagaaaagagcccgttattttttagaggaaaatttagtgcattttgtagcgagtgatatgcataaccttgatgttagaccgccatttttagcagaagcttataagattatctgtagagatttcggtaaagaacgtgctaaccaactttttattgaaaatgctcaatctatattaaaaaaccattacatt

SEQ ID NO: 9878 - protein, 197 aa, Streptococcus agalactiae
MFETPEDIIFKNFSIVKHEAEKRFEHLQILYGGELYYTSDMLEKLKLKQIPTLNNTKFALIEFSMQTSWKDIHTALSNVLMLGITPVVAHIERYNALENQKERVKEIINMGCYTQINSSHILKQKLFNDKHKRFKKRARYFLEENLVHFVASDMHNLDVRPPFLAEAYKIICRDFGKERANQLFIENAQSILKNHYI

SEQ ID NO: 9879 - DNA, 870 bp, Streptococcus agalactiae
atgaatgaagccgctaaacaactctacattacccaaccttcactttcaaacgctgttaggaaccttgagactgagatgggtatccaaatttttattcgaaatccaaaaggaataacgttaacaaaagatggtatggaatttctgtcatatgcgcgacaaattctagaacaaacagcacttcttgaagagcgttataagggtgataatacaagtcgtgagctgttcagcgtttcttcacaacactatgcatttgtggttaacgcttttgtagctctctttaatggcacagacatgacccaatacgaactttttttacgtgaaactaggacttgggaaattattgatgatgttaaaaatttccgttcagagattggtgttctgtttcttaatagctataatagagatgtattaaccaaattattcgacgataattccttaattgccacaactctttttactactacacctcatattttcgtgagcaaatccaatcccttagctaatagaaaaaaattaaatatgaaagatttagaagattatccttatctgagttatgatcaaggcctgcataattctttctacttttctgaggaaatgatgtctcaaattcctcacccaaaatccattgttgtcagtgatagagcaactctgtttaatttaatgattggattagatggttatacagtggcaactggtatcctcaactcaaaattgaacggtgacgaaattgtcgcaatccctcttgacgtggatgatgttattgatattgtctatatccgacacgacaaagcaaacctttcaaaaatgggacaaaaatttattgactatttattagaggaagtttcgtttaatcataaaaataaacagtcc

SEQ ID NO: 9880 - protein, 290 aa, Streptococcus agalactiae
MNEAAKQLYITQPSLSNAVRNLETEMGIQIFIRNPKGITLTKDGMEFLSYARQILEQTALLEERYKGDNTSRELFSVSSQHYAFVVNAFVALFNGTDMTQYELFLRETRTWEIIDDVKNFRSEIGVLFLNSYNRDVLTKLFDDNSLIATTLFTTTPHIFVSKSNPLANRKKLNMKDLEDYPYLSYDQGLHNSFYFSEEMMSQIPHPKSIVVSDRATLFNLMIGLDGYTVATGILNSKLNGDEIVAIPLDVDDVIDIVYIRHDKANLSKMGQKFIDYLLEEVSFNHKNKQS

SEQ ID NO: 9881 - DNA, 765 bp, Streptococcus agalactiae
atgacagatttttcaactgctcttaaagtattagtggatcagtattcttatcataatgctttcttattattacaaaaacatggtcctttaaactcagatttattatttttattggaaatgatgaaagagcgtcgagagttaaacattgattttctttttgctcatcaagaacaagttgttatattacaagaaaaatacaatataaagcttttgcataacccgtatgatttagagttgctggcaaattacatcatggatttagaagcaaaagtaaaaaacggattaatcatagattttgtccgtagtgttagtcctattttatatcgtctatttatgattttacttgcacaagaagtacctcacttgcatgattacatccataatgcaagagatgatcactacgatacttggaagtttaaagaattaaaggagtcaaaccacccagtccttttggcattctctgaaaggtggcacgatagtcgcttgacttctaaaagcctggcagaatgtttacaattaaccgaccttgatgaagaagtgaaatcgaccatcattcaattaagacagttcgaaaaatcagtcagaaatcctttggctcacctgattaaaccttttgatgagcaagaactatatcgtacaactcaattttcttctcaagcatttttagaccagattatcttcttggcaaaggtaattggtgttgagtatgatactgttaattttcactacgatacggttaacaagcttattataaatatacttgag

SEQ ID NO: 9882 - protein, 255 aa, Streptococcus agalactiae
MTDFSTALKVLVDQYSYHNAFLLLQKHGPLNSDLLFLLEMMKERRELNIDFLFAHQEQVVILQEKYNIKLLHNPYDLELLANYIMDLEAKVKNGLIIDFVRSVSPILYRLFMILLAQEVPHLHDYIHNARDDHYDTWKFKELKESNHPVLLAFSERWHDSRLTSKSLAECLQLTDLDEEVKSTIIQLRQFEKSVRNPLAHLIKPFDEQELYRTTQFSSQAFLDQIIFLAKVIGVEYDTVNFHYDTVNKLIINILE

SEQ ID NO: 9883 - DNA, 1170 bp, Streptococcus agalactiae
atgcactatgtattaatgtttacagagtggttagcatttggtgatagtagagaaaatactctgtctttgttaaatagtgtcacaccaattaaaagagtgttatcacttactttagtctcctttttagcatcccttagttggtattacttacaaatcaaaccaaagcaaataactagtattaaacaacaggttgtttttaaggatttttctgtaaaaaaatcaccttactggctacatataggtcacgcatttttgcaattgatttatgtaggaactggtggccctattggaaaagaaggagcgccacgagagtttggagccataaatgctgggaaaatatcggatttattagcacttaaagtgctggataaacgtttattaatcattagtggtgcagctgcaggtttgtcagcagtttatcaagtccccctagctagtgtattctttgcttttgaaactttagctttaggaatctcactgaaaaatattgtgacattgctagcctctacttttggtgcagctagtattgctcaattagttatttcgacagcccctctttatcatatttcaaagatgagtctgaattcacagtcattagcttttatgttcttgatcgttttatgtgtaactccgattgcgattagctttagatatttaaatcaaaaagtgacagagagacgtattaaaaatataaaaatattgttaagtttgccagtagtgtcattgatagtatctgttttatcaatcgtctatccccagattttaggaaatggtaatgccctagttcaagaagtctttaaagggaccacagttagcttaatcgctattttagttgttctcaagatgatagcaacattatccactctttacgctggtgcttatggcggtatactgacaccatctttttccattggtgcttgtttaggttttttgttagctagtatttctattcctttacttccccacatatcgatagtaaccagtatgttggttggtgcagctatttttttagctattacaatgagagcgccactgacagctgtcggtttagtcatatcttttactggtcaatctgttataactattgttcccctaactatagcagtactttttgctactgcctatgattattttataagaaaaatgaggagtttatatgtcaatccatat

SEQ ID NO: 9884 - protein, 390 aa, Streptococcus agalactiae
MHYVLMFTEWLAFGDSRENTLSLLNSVTPIKRVLSLTLVSFLASLSWYYLQIKPKQITSIKQQVVFKDFSVKKSPYWLHIGHAFLQLIYVGTGGPIGKEGAPREFGAINAGKISDLLALKVLDKRLLIISGAAAGLSAVYQVPLASVFFAFETLALGISLKNIVTLLASTFGAASIAQLVISTAPLYHISKMSLNSQSLAFMFLIVLCVTPIAISFRYLNQKVTERRIKNIKILLSLPVVSLIVSVLSIVYPQILGNGNALVQEVFKGTTVSLIAILVVLKMIATLSTLYAGAYGGILTPSFSIGACLGFLLASISIPLLPHISIVTSMLVGAAIFLAITMRAPLTAVGLVISFTGQSVITIVPLTIAVLFATAYDYFIRKMRSLYVNPY

SEQ ID NO: 9885 - DNA, 786 bp, Streptococcus agalactiae
atggcattttttaatattgaatatcactctaaggtactaggaacggaacgtcaagtcaatgttatttacccagatgcttttgagatgtctgatgataaaattgatgattgtgacattcctgttttgtatcttctccatggaatggggggaaatgagaattcttggcaaaaacgcacaaatatagagcgtcttttacgtcatactaatcttatcgtcgtgatgccatcaacagacttagcatggtataccaacacaaagtatgggttggattattttgatgcaatagctatcgagttaccaaaagttttgaaacgtttctttcctaatatgtctgataagagagagaaaaatttcattgccggattatctatggggggatatggagcatataaaatagctctactgactaatcgtttttctcatgctgcctctttgtcaggtgcactttcttttgactttgatttattattcaataatggcaacaataacattaactattggtcgggaatttttggcgatttgaataacactgataacatagagcgtcattcactaaggcgttacgttgagtcttttgatatgaagactaaattttatgcatggtgtggttatgaagattttctttttgaagctaatgaagtcgcaattgatgaacttcgtcaattaggtttaactattgactatttcaatgatcatggtaaacatgaatggtattactggaatcaacaattagaaaaagtcttagaatggctccctgttgattatgtcaaagaagagcgcctttct

SEQ ID NO: 9886 - protein, 262 aa, Streptococcus agalactiae
MAFFNIEYHSKVLGTERQVNVIYPDAFEMSDDKIDDCDIPVLYLLHGMGGNENSWQKRTNIERLLRHTNLIVVMPSTDLAWYTNTKYGLDYFDAIAIELPKVLKRFFPNMSDKREKNFIAGLSMGGYGAYKIALLTNRFSHAASLSGALSFDFDLLFNNGNNNINYWSGIFGDLNNTDNIERHSLRRYVESFDMKTKFYAWCGYEDFLFEANEVAIDELRQLGLTIDYFNDHGKHEWYYWNQQLEKVLEWLPVDYVKEERLS

SEQ ID NO: 9887 - DNA, 759 bp, Streptococcus agalactiae
atggtgatgaaaatcatagagttaaaagaagcaaccgtacaagtcagtaatggtttagcagaaatgaaaacgatattagatcatgttaatttgagtatttatgaacatgacttcattacaatattgggtggaaatggagctggaaaatcaacgctttttaatgtaattgcaggtaccttgatgttaagcagtggaaatatttacatcatgggacaagatgttactaatttatcagcagaaaaacgagctaaatatttatcacgggtatttcaagatccgaaaatgggaacagcacctaggatgacagttgctgaaaatttattagttgctaaatttcgaggtgaaaagagaccgctagttcctagaaagattattaactatacggaagaatttcaaaaattgattgctagaactggtaatggacttgatcgccatttagagacacctacaggtttattatcaggtggacaaagacaagcgcttagtttattaatggcaactttgaaaaaaccaaatctgttattattggacgaacacacagcagcgcttgatcctagaacaagtgtttcgcttatgggcttgactgatgagtttatcaaacaagattcgttgactgccttaatgattacacatcatatggaagatgctctcaaatatggaaatcgtgtattagtaatgaaagatggcaagattgtcagagatttaaatcaggcacaaaaaaacaagatggctatagctgactattatcaattatttgat

SEQ ID NO: 9888 - protein, 253 aa, Streptococcus agalactiae
MVMKIIELKEATVQVSNGLAEMKTILDHVNLSIYEHDFITILGGNGAGKSTLFNVIAGTLMLSSGNIYIMGQDVTNLSAEKRAKYLSRVFQDPKMGTAPRMTVAENLLVAKFRGEKRPLVPRKIINYTEEFQKLIARTGNGLDRHLETPTGLLSGGQRQALSLLMATLKKPNLLLLDEHTAALDPRTSVSLMGLTDEFIKQDSLTALMITHHMEDALKYGNRVLVMKDGKIVRDLNQAQKNKMAIADYYQLFD

SEQ ID NO: 9889 - DNA, 717 bp, Streptococcus agalactiae
atgtcagaaacagttaaattatttcaatacagtaccttgagttcactgatggcaggattgtacaaaggcagtctaactatcggagaattattaactcacggtgacttaggaatcggtactgttcatatgattgatggtgaattgattgtattggatgggaaagcttatcaagctattggtacagatggtaaagcagagattatccaattatcagatgatgtgacagtaccctatgcagcggttttaccacaccatatccaaaaacaatttgatatcaatgctgagatagataataaggatttggaagagatgattctaaaaaactttgaaggtcaaaatctctttaagtctttaaaaatcaaaggaacgttttcaagaatgcacgttcgtatgattccaaaatctccacaacataaacgttttgcagatattgcatctaatcagccagaatttaccagagagaatgtatctggtacgttggttgggatttggacgccggaattatttcatggtgtgggggtaaaagggttccatgtccactttatttcagacgatttaactttcggtgggcatgttatggattactcgctcacacaaggaaaagttgaaattggaaaggttgaccaacttgaccaatgtttcccaactcaagatcaagaatttttgaaagctaactttgacctacaaaagcttagagaagatattgatttaagtgaa

SEQ ID NO: 9890 - protein, 239 aa, Streptococcus agalactiae
MSETVKLFQYSTLSSLMAGLYKGSLTIGELLTHGDLGIGTVHMIDGELIVLDGKAYQAIGTDGKAEIIQLSDDVTVPYAAVLPHHIQKQFDINAEIDNKDLEEMILKNFEGQNLFKSLKIKGTFSRMHVRMIPKSPQHKRFADIASNQPEFTRENVSGTLVGIWTPELFHGVGVKGFHVHFISDDLTFGGHVMDYSLTQGKVEIGKVDQLDQCFPTQDQEFLKANFDLQKLREDIDLSE

SEQ ID NO: 9891 - DNA, 1224 bp, Streptococcus agalactiae
atgttgaatagtgaaaaaatgattgtttctatccaaaatcaggatttagaacatgctaacaagtatttcgaaaaagcgttgaaaaatgatcctgaggaagtcttgttggaactaggagcttatttggagagtattggttttttaccccaagcaaaacgtctctatgatcaaatccgaccaaattatccagaagttgctatcaatttagctcaaattgttgccgaagatggagatattgaacaagcattcttatacttagattatatctcagaagatagtcaagagtatgtttcagccctccttgttatggctgacttatatgatatggaaggcttgactgatgttgcgcgtgaaaagcttttgctagccagcaaacttagcgatgacccattggttacatttggtttagctgaaatgaaccttagtttggaacattatcaagaagcgatagaaggatatgcctcacttgacaatcgagaaatcttagaaacgactggagtttcaacttatcagcgtattggtaaatcctacgctattatggggaaatttgatgcagctatcgaatttttagaaaaagccgttgacattgagtatgatgatttaacagtttttgagttagcaacaatcctttatgatcaagaagaatatcaaaaagctaacctttattttaaacagttggatactattaatccagactttgctggctatgaatatatctatggtttatctcttcgtgaggagcataaatctgaagaagctttacgtctagttcagcaaggtattcgtaaaaatagttttgatggtcaacttctcttactagcctcacaattatcgtatgaattacatgatgttcattcgtcggagtcttatttgaaacaagctgaaaaagtttctgaaaatcaagatgaaattgttatgagattgtcaaatttgtatcttgaagaagagcggtttgaggaagtcttggaattagacaatgataatttagaaaatatccttgcaaaatggaatatcgctaaagcacacaaggctttagaaatggatgatagtgtagactattatcaatctttgtataatgatttaaaagataatccagaatttttacaagattatgcttacattttgagagaatttggttaccttgataaggcacaagaagtaggaaaggcttatttaaaattagttccagatgatatagagatgtcagaatgggtgaataacatt

SEQ ID NO: 9892 - protein, 408 aa, Streptococcus agalactiae
MLNSEKMIVSIQNQDLEHANKYFEKALKNDPEEVLLELGAYLESIGFLPQAKRLYDQIRPNYPEVAINLAQIVAEDGDIEQAFLYLDYISEDSQEYVSALLVMADLYDMEGLTDVAREKLLLASKLSDDPLVTFGLAEMNLSLEHYQEAIEGYASLDNREILETTGVSTYQRIGKSYAIMGKFDAAIEFLEKAVDIEYDDLTVFELATILYDQEEYQKANLYFKQLDTINPDFAGYEYIYGLSLREEHKSEEALRLVQQGIRKNSFDGQLLLLASQLSYELHDVHSSESYLKQAEKVSENQDEIVMRLSNLYLEEERFEEVLELDNDNLENILAKWNIAKAHKALEMDDSVDYYQSLYNDLKDNPEFLQDYAYILREFGYLDKAQEVGKAYLKLVPDDIEMSEWVNNI

SEQ ID NO: 9893 - DNA, 786 bp, Streptococcus agalactiae
atgaaagctagagaacttattgatgtatatgaaacttattgtccacaggaattatctatggaaggagatatttcaggtcttcaaattggatctttagataaagaaataaagacagtcatggtagctttagatgttcgagagactacagtagctgaagcaattgaacgtcaagtagatcttcttattgtaaagcatgctcctatttttcgtccattaaaggatttggtagcaacgccgcaaaataagatttatatagaccttcttaaatcagacattgctgtttatgtgagccatactaatatagatatcgttcctaatggacttaacgactggttttgtgaattattagatattcaatatcccgatatattatctgagacaagtaatggttatggtattggtcgcattggtgatattagaccccagagttttgaattttttgcatggaaaattaaagatgtgtttggtttagatagcgttcgtttagtttcatatgataaatctaatcctgaaattcaacgagttgctatttgtgggggtagtgggcaaagtttctacaaagaagctattgcaaaaggagcagatgtttttgtaacgggagatatttattatcatactgcacaagaaatgatcacaaatggtttgcttgcgattgacccaggtcatcatattgaggttttatttgtttctaaaatagctactatgattgagcagtggaaacttgaaaaaggctgggatatttcagttttagagagtaaagctccaacaaatcccttttaccatatg

SEQ ID NO: 9894 - protein, 262 aa, Streptococcus agalactiae
MKARELIDVYETYCPQELSMEGDISGLQIGSLDKEIKTVMVALDVRETTVAEAIERQVDLLIVKHAPIFRPLKDLVATPQNKIYIDLLKSDIAVYVSHTNIDIVPNGLNDWFCELLDIQYPDILSETSNGYGIGRIGDIRPQSFEFFAWKIKDVFGLDSVRLVSYDKSNPEIQRVAICGGSGQSFYKEAIAKGADVFVTGDIYYHTAQEMITNGLLAIDPGHHIEVLFVSKIATMIEQWKLEKGWDISVLESKAPTNPFYHM

SEQ ID NO: 9895 - DNA, 825 bp, Streptococcus agalactiae
atgtttgattgtggagagggtacacagcgtcaaattttagaaactacgattaaacctcgtaaagttaaaaaaatttttatcacgcacatgcacggagaccatgtttttggtcttccaggttttttatccagtcgggcttttcaagccaatgaagagcagacagatttagatatttatggaccggttggtataaaaagttttgttatgactgccttaaggacatcaggttcacgtttaccttatcgaatccattttcacgagtttgatgaatcatcactcggaaaaattatggaaacagataaatttaccgtttatgcagaaaagctagatcatactatcttttgtatgggatatcgtgttgtgcaaaaagatcttgagggcactttagatgctgaagcattgaaactagcaggtgttccatttggtcctctttttgggaaagtcaaaaatggtgagaatgttaccttagaagatggtagagaaattattgctaaagattatatttctgaaccgaaaaagggtaaagtaatcactattttgggagatactagaaaaacagatgcaagtattaggttagctttgggcgctgatgttttagttcacgaatctacttatggtaagggtgatgagcgaattgctaaatcgcatgggcattcaaccaatatgcaagcagctgatatcgctaaacaagcaaatgctaaacgactattattaaatcatgttagtgctcgttttatggggcgagattgttggcaaatggaagaagatgcaaagacgattttttcaaatacccatcttgttagagatttggaagaagtaggtata

SEQ ID NO: 9896 - protein, 275 aa, Streptococcus agalactiae
MFDCGEGTQRQILETTIKPRKVKKIFITHMHGDHVFGLPGFLSSRAFQANEEQTDLDIYGPVGIKSFVMTALRTSGSRLPYRIHFHEFDESSLGKIMETDKFTVYAEKLDHTIFCMGYRVVQKDLEGTLDAEALKLAGVPFGPLFGKVKNGENVTLEDGREIIAKDYISEPKKGKVITILGDTRKTDASIRLALGADVLVHESTYGKGDERIAKSHGHSTNMQAADIAKQANAKRLLLNHVSARFMGRDCWQMEEDAKTIFSNTHLVRDLEEVGI

SEQ ID NO: 9897 - DNA, 888 bp, Streptococcus agalactiae
atgagaaaaatcaaacttatagcagttgttggtccaactgcggttgggaagacagcattaggaattgaattagctaaaactttcaatggcgaaatcattagtggtgatagtcagcaagtttatcagaagttagatatcggaacggctaaagctagtaaagaagagcaagaacaagcttatcatcacttgattgatgttcgtgaagtaaatgagaactattcggtttatgatttcgtcaaagaggcaaaagtagctattgatacgattatttctaaggggaaaattcctattattgttggaggtactggcctatatttacagagtttgtttgagggctatcatttaggaggcgaagtcaatcaagaaactcttatggcctatcgtgaaaaattagagtctctaagtgatgaagatttatttgaaaagttgacagaacaatccattattataccacaagttaatcgtcgacgtgccattcgtgcattagaattggcgaagtttgggaatgatttgcaaaatagtgaaagtccgtatgatgttttattaattggattgaatgatgatcgtcaggtgctttatgatcgtatcaatagacgagttgatttgatgatggacaatggtctcttagatgaagctaaatggctatacgataactacccgagtgttcaagcaagtaaaggaattggctataaagaattatttccttacttttcaaagcaaataccattagaagaagctgttgataaactaaaacaaaataccagacgttttgcaaaacgccaattaacatggtttagaaaccgtatgaatgtcgaatttattatggttggtgaggaaaattatcaacaaaaaatcaagcgaaaagtcagtgattttttatcatcaaag

SEQ ID NO: 9898 - protein, 296 aa, Streptococcus agalactiae
MRKIKLIAVVGPTAVGKTALGIELAKTFNGEIISGDSQQVYQKLDIGTAKASKEEQEQAYHHLIDVREVNENYSVYDFVKEAKVAIDTIISKGKIPIIVGGTGLYLQSLFEGYHLGGEVNQETLMAYREKLESLSDEDLFEKLTEQSIIIPQVNRRRAIRALELAKFGNDLQNSESPYDVLLIGLNDDRQVLYDRINRRVDLMMDNGLLDEAKWLYDNYPSVQASKGIGYKELFPYFSKQIPLEEAVDKLKQNTRRFAKRQLTWFRNRMNVEFIMVGEENYQQKIKRKVSDFLSSK

SEQ ID NO: 9899 - DNA, 348 bp, Streptococcus agalactiae
atggaatttgccataggccgtgtggaagcgcacgttttagctcactttgattatggttttcgtaagttaaacttagatgtagaagatttaaaaccgtttgaaacgcaattgaagcgcattttcataaagatgttatctaaggggttagcttttgaactaaataccaaatccctttatctatatgggaatgaaaaactttatcgctatgctttagagatactcaaacagcttggttgtaaacaatactctataggctctgacggtcatattcctgaacatttttgttatgaatttgatagacttcaaggtctgctaaaggactatcaaattgatgaaaatcatttgata

SEQ ID NO: 9900 - protein, 116 aa, Streptococcus agalactiae
MEFAIGRVEAHVLAHFDYGFRKLNLDVEDLKPFETQLKRIFIKMLSKGLAFELNTKSLYLYGNEKLYRYALEILKQLGCKQYSIGSDGHIPEHFCYEFDRLQGLLKDYQIDENHLI

SEQ ID NO: 9901 - DNA, 552 bp, Streptococcus agalactiae
atgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgactaaagacaattggactttactttttaatcatcccttagctttattactctttatactttatatcgtaatcctaattgggttcatctatactgagttcgctatctatactattgccatactgaaaactgaattttctctcagtatcaaaaaatggctaacaatctttcctaaaaaaataaaatcacttttaggaccacagctaatttgggtatcaatctacttacttttgacaattcctctagctaaccttggtctaaggtcaagtatactagagcatcttaaaattcctgactttatttctggcgagttaacaaagacagtctttggaaagataggttactctacccttttactgcttatttgttacttaaacctt

SEQ ID NO: 9902 - protein, 184 aa, Streptococcus agalactiae
MLRALKEDFFLTLTSLKNQFWVYIGTGILIQTLVAYLVKGILSFIFRRILILSNTPAVTKDNWTLLFNHPLALLLFILYIVILIGFIYTEFAIYTIAILKTEFSLSIKKWLTIFPKKIKSLLGPQLIWVSIYLLLTIPLANLGLRSSILEHLKIPDFISGELTKTVFGKIGYSTLLLLICYLNL

SEQ ID NO: 9903 - DNA, 759 bp, Streptococcus agalactiae
atgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcc

SEQ ID NO: 9904 - protein, 253 aa, Streptococcus agalactiae
MPHSSYYYQAVESVSETEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRGKEFDNQLIDEILEAFGITRSLSQAGCPYDNAVAESTYRAFKIEFVYQETFQLLEELALKTKDYVHWWNYHRIHGSLNYQTPMTKRLIA

SEQ ID NO: 9905 - DNA, 258 bp, Streptococcus agalactiae
atggcttactaccaggcttgcacggaaaaagacattatccgctcaatgtctcgaaaaggaacacctgcagataatgcctgtattgaatggtttcacaccgtcctaaagactgaaaccttttatttccataataggagaaaatacaacaaagatagtataacaaatattgttaaaaattacattacattttataatgaaactagaattcaacagagattaaacgaccagtcgcctgtacagtacagaaaactgattgcc

SEQ ID NO: 9906 - protein, 86 aa, Streptococcus agalactiae
MAYYQACTEKDIIRSMSRKGTPADNACIEWFHTVLKTETFYFHNRRKYNKDSITNIVKNYITFYNETRIQQRLNDQSPVQYRKLIA

SEQ ID NO: 9907 - DNA, 231 bp, Streptococcus agalactiae
atgcattctttttctaatcctggatatccttatgataatgccgtaactgaagcatttttcaagtatttaaagcatagacaaatcaaccgaaaacattatcaaaatatcaaacaggttcaattagactgctttgaatacattgagaatttttataacaattacaacccacatacggctaatctaggactaacccctaatcagaaagaagaaaattattttaacgcaataaaa

SEQ ID NO: 9908 - protein, 77 aa, Streptococcus agalactiae
MHSFSNPGYPYDNAVTEAFFKYLKHRQINRKHYQNIKQVQLDCFEYIENFYNNYNPHTANLGLTPNQKEENYFNAIK

SEQ ID NO: 9909 - DNA, 1275 bp, Streptococcus agalactiae
atgtcagaattgctagataagatattatctcggaacaatatgctcgaagcttacaagcaagtgaaatcaaacaaaggttctgctggtatcaatggggtcactatcgagcagatggatgactatcttcaccaaaattggcgagaaaccaagcaactcatcaaagagaggagctataaacctcaaccggttctcagggttgaaatcccaaaaccaaacggaggagttcgtaacctaggtatcccgacggctatggatagaatgattcagcaggccatcgttcaagttttgagtccactctgcgaaaaacatttttcagagtatagctatgggttcagacccaatcgctcctgcgaaacagccattgttcagctacttgagtatttaaacgatggctacgagtggattgtggacattgacttggaaaagttcttcgatactgttccgcaagacagattgatgtccctggttcataatatcattcaagatggcgatacggagtcactgattcgtaagtacctccattcgggagttgttattaacggacagcgacataagactttagtcgggacacctcaaggcgggaatctatcacccctcctatctaatattatgcttaatgagttagacaaagggttggaaaagcgaggtcttcgctttgtccgttacgccgatgactgtgtcatcactgtcggaagcgaagcagctgctaagcgggtcatgcattcggtcagtagctatattgagaagcgattagggttgaaagtcaacatgactaagaccaagattgtcagaccgaacaaactcaaatacctcggatttggtttctggaaatctccaaaaggttggaagtgtcgtcctcaccaagacagcgttcagagctttaagcgaaaactgaagcaactgacgatgaggaaatggagcattgacctgataactcgcattgaacgattgaactgggtcattcgaggatggataaactatttctcgcttggcaatatgaagagtatcatgacacaaatagatgagcgtctgcgaacccgtattcgagtgattatctggaagcaatggaagaagaaagcaaagcgcctatggggactcttaaaactaggagttgctagatggatagccgataaagtttctggatggggtgaccactatcagttggtagctcagaagtcggtactcaaacgtgctatatcaaaaccagccctcgcaaagcgaggactggtcagttgcttagattactatcttgaacgacatgcgttaaaagttagt

SEQ ID NO: 9910 - protein, 425 aa, Streptococcus agalactiae
MSELLDKILSRNNMLEAYKQVKSNKGSAGINGVTIEQMDDYLHQNWRETKQLIKERSYKPQPVLRVEIPKPNGGVRNLGIPTAMDRMIQQAIVQVLSPLCEKHFSEYSYGFRPNRSCETAIVQLLEYLNDGYEWIVDIDLEKFFDTVPQDRLMSLVHNIIQDGDTESLIRKYLHSGVVINGQRHKTLVGTPQGGNLSPLLSNIMLNELDKGLEKRGLRFVRYADDCVITVGSEAAAKRVMHSVSSYIEKRLGLKVNMTKTKIVRPNKLKYLGFGFWKSPKGWKCRPHQDSVQSFKRKLKQLTMRKWSIDLITRIERLNWVIRGWINYFSLGNMKSIMTQIDERLRTRIRVIIWKQWKKKAKRLWGLLKLGVARWIADKVSGWGDHYQLVAQKSVLKRAISKPALAKRGLVSCLDYYLERHALKVS

SEQ ID NO: 9911 - DNA, 606 bp, Streptococcus agalactiae
atggttaagaaaaaagtaaagaaaaaaagtggttgtggtggatgtttaagtttaataatagtgataattattgttagtagtgttataaatttatttacaggttctgaaagcagtaatacttctaaaaagaataagacaaatcctagtggtgcgacaagtgcaaaagtcgttaaacacaaaaaaactgatgaagaacgagcagaagattatataaaaacgttaggattaaacccgagtgattatataaaagaaatggattattcaaaggttgattttaggggggatttatcatcagtatcaggtaattataataattttactgttgaaaacatcaatcaaacttttgaaaaaggtgataaatctttaaaagatattattgaaatttttggaaagcctgatacaatttgggttaattacgttgacaatcagtacaatactgatttgtactggaaaaaagatgacacagatgattctaattatattcatgcagaatggtctgagccaaaagatgaatatgatgttcaaagtttaagtggcacggcttcaaattcaggtactggcaagtttcagtcattcattggattagatggatttgagcctgcacag

SEQ ID NO: 9912 - protein, 202 aa, Streptococcus agalactiae
MVKKKVKKKSGCGGCLSLIIVIIIVSSVINLFTGSESSNTSKKNKTNPSGATSAKVVKHKKTDEERAEDYIKTLGLNPSDYIKEMDYSKVDFRGDLSSVSGNYNNFTVENINQTFEKGDKSLKDIIEIFGKPDTIWVNYVDNQYNTDLYWKKDDTDDSNYIHAEWSEPKDEYDVQSLSGTASNSGTGKFQSFIGLDGFEPAQ

SEQ ID NO: 9913 - DNA, 228 bp, Streptococcus agalactiae
atggcatttgaaccaaaaaattcggaactaacaaaagttctaaaagaaagtttagatgaagaaaagaaagaaattttctcatctgaaatgaatattagggactttgaacgtacaaaacaatatcaatttacacttcaaccttcagtccgaaaaaaaattgataggctatcaaaagaaaaaggctatcgttcagcatcatcttttataaatgacttttttaaaaatttg

SEQ ID NO: 9914 - protein, 76 aa, Streptococcus agalactiae
MAFEPKNSELTKVLKESLDEEKKEIFSSEMNIRDFERTKQYQFTLQPSVRKKIDRLSKEKGYRSASSFINDFFKNL

SEQ ID NO: 9915 - DNA, 759 bp, Streptococcus agalactiae
atgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtagcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcc

SEQ ID NO: 9916 - protein, 253 aa, Streptococcus agalactiae
MPHSSYYYQAVESVSETEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRSKEFDNQLIDEILEAFGITRSLSQAGCPYDNAVAESTYRAFKIEFVYQETFQLLEELALKTKDYVHWWNYHRIHGSLNYQTPMTKRLIA

SEQ ID NO: 9917 - DNA, 1197 bp, Streptococcus agalactiae
atggcaacaaaaagtagtaaaaaatacaaaggtgtttattgtgataataagggaaagatattttatcagattgatcttggaatcgacccagtaactggcaaaagggtacaaaagaaagctagaaaaaatcaatatggtaaaacctttgaaacaatgaaagaagcatatgacgaattagttcgtataaaatatgaatttgccaacaaagtcagtttagaaaattacaatatgacttttgaaaactatatgaacaaaatttatttaagagcatataagcaaaaggttcagtctgtgacatataagacggctcttcctcatcataaactttttattcaatattttggtttaaagccattaaaagcaataactcctagagattgcgaagcttttagattgcatatcatagagaattattctgaaaactatgcgaaaaatttatggtcaaggtttaaagcttgtatgggttatgcagaaagacttggctatatttcaaatatgccttgtaaagcattagataatcctagaggtaaacatccagaaactccattttggacctatgcggagtttcagacatttatcaaatcatttgacttacatgattatgaagaattgcaacgatttactgccatctggttatattatatgacaggtgtacgagtgagcgaaggtttatctttatgttgggaggatattgattttgataaaaaatttctaaaggtacatacaaccttagagaaagatgaaaatggtaattggtatcgtaaagaccaaacaaagactccagcaggtgaacgacttattgaattggatgatattactattgaagtacttcaagtttggcgaaaaaatcagtttgcaaatcaagatacagattttatcatttcaagatttggagatcctttttgcaaatcaaccatttgtcgcatcatcaaacggaaagctcaacaggtaggagttccagtaattacaggaaaaggtctcagacatagccatgcatcctatctaatcaatgtcttgaaaaaagatattttatatgtagccagacgtatgggacatgccgataaatcaacaactttgaatacttacagtcactggtttaatgctttagataaaacagtttctgaagaaatcacacaaaatatcaaaagtgcaggattggattcaattttatgccaaaattcctgccaaacttcaaat

SEQ ID NO: 9918 - protein, 399 aa, Streptococcus agalactiae
MATKSSKKYKGVYCDNKGKIFYQIDLGIDPVTGKRVQKKARKNQYGKTFETMKEAYDELVRIKYEFANKVSLENYNMTFENYMNKIYLRAYKQKVQSVTYKTALPHHKLFIQYFGLKPLKAITPRDCEAFRLHIIENYSENYAKNLWSRFKACMGYAERLGYISNMPCKALDNPRGKHPETPFWTYAEFQTFIKSFDLHDYEELQRFTAIWLYYMTGVRVSEGLSLCWEDIDFDKKFLKVHTTLEKDENGNWYRKDQTKTPAGERLIELDDITIEVLQVWRKNQFANQDTDFIISRFGDPFCKSTICRIIKRKAQQVGVPVITGKGLRHSHASYLINVLKKDILYVARRMGHADKSTTLNTYSHWFNALDKTVSEEITQNIKSAGLDSILCQNSCQTSN

SEQ ID NO: 9919 - DNA, 222 bp, Streptococcus agalactiae
atgtaccgacgtttaagggatttgagagaagacaatgatttcactcaaaaatacgttgccgaaaagctttcgtttacccactctgcttattcaaaaattgagagaggagaacgtattttatcggcagatgtaataataaaactttcaaatctatataacgttagtacagattatttgttggggcaaactgactttccccaccgaataaagaataatttaaaa

SEQ ID NO: 9920 - protein, 74 aa, Streptococcus agalactiae
MYRRLRDLREDNDFTQKYVAEKLSFTHSAYSKIERGERILSADVIIKLSNLYNVSTDYLLGQTDFPHRIKNNLK

SEQ ID NO: 9921 - DNA, 1305 bp, Streptococcus agalactiae
atgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagacaacttaggtgtcgatttttccacacttattaagaatttggagaagggtgattta

SEQ ID NO: 9922 - protein, 435 aa, Streptococcus agalactiae
MSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITDNLGVDFSTLIKNLEKGDL

SEQ ID NO: 9923 - DNA, 594 bp, Streptococcus agalactiae
atgttaaatcaatattttctgcattttgaagagagtaaaatagttactcccttatatgctttcgacattgattatctgaatattcctaaatatgtcggtctatcaaaggagcagattctggaaaactaccgcatcctcctgacctatttgaatatcccatggtttctcgcattggatatgccggatttccctagttcggctagtgggcttttccactttttcgaggtcaagaagctttttatgctggactacctgatcttgatcttttctggaatgggcacgctatggtttgtacgacatctaaataggagacgagaatcttggcggctcctaccctacttccgccagggaacccttattccccttgctatccttttggctctcctggttagcttcgacacgctgtttgtgcttttccataaagttttctttaacaatgacgcctggctcttcaatgccactactgatcctattatcttagctttacctgccgagttctttatgcacagtttcctcttggcctttggattaatcgaagtcttcctaatcctggggtacttcactactaaatatcgaatctctgccccaagccgt

SEQ ID NO: 9924 - protein, 198 aa, Streptococcus agalactiae
MLNQYFLHFEESKIVTPLYAFDIDYLNIPKYVGLSKEQILENYRILLTYLNIPWFLALDMPDFPSSASGLFHFFEVKKLFMLDYLILIFSGMGTLWFVRHLNRRRESWRLLPYFRQGTLIPLAILLALLVSFDTLFVLFHKVFFNNDAWLFNATTDPIILALPAEFFMHSFLLAFGLIEVFLILGYFTTKYRISAPSR

SEQ ID NO: 9925 - DNA, 1413 bp, Streptococcus agalactiae
atgggctatgtcgactactcaaaagaacctcgtagcgatattgcttttgtcgatatgaaatccttctatgcatctatcgaatgtgtagagagaggacttcacccgcttcatacttcactttgtgtgatgagtagggcagataattcagctggtctaattctagcttcttctccaatgttcaaaaaagtctttggtaaaggaaatgttggcagagcctacgacctcccctttgatgttcataccagaaaatttaactactaccgtgctaaaatttcaggattgccaacggatgcaaaatttgtttccttcatagaaaattgggccaagcgtacatttattgtgccaccgagaatggacttgtacattcaaaaaaatcttgaaatacaaaaagtatttcaaaattatgcagatccgacagatattctgccctattctattgatgaaggatttattgacttaacttcatcgctaaattattttgttgaagacaaatctctgagtcgcaaagataagttagatgtggtttcagcaaaaattcaacacgatatttgggaaaaaacgggtgtctattcaactgttggaatgagtaatgccaatccacttctagctaagttagcacttgataacgaagctaaaaccactgctaccatgcgtgccaattggtcttatgaagatgttgaaacgaaggtctggaatattcccaaaatgactgacttttggggaataggttcacgaacagaaaaacgactaaacaaattgggaatctacagcattaaagaattggccaactgtgaccctactatcttgaaaaaagaatttggtgttattggagtacaacattggtttcatgctaatggcatcgatgaaagtaatgtccatgaaccttatcgccctaaagcagtcgggattgggaattcgcaagtgctccataaagattacactcgtcaaagtgatatagagcttgtcctgcgtgagatggcagagcaagttgcgattcggctacgcagaagacataaaaaagcaactgtagtcgccataaatgtaggctattcaaatttcgaaaacaagaaatcaatcaatgttcagagaaaaattaacccaaataatcgtacgcttgtttttcaagatgaagttgtttctctctttcgttctaaatacgatggaggggcagttagaagcattgctgtaaggtacgatggattggtggatgaaaactttgctgtgatttctctttttgatgactttgaagaaagcgaaaaagaggaaaaattggagacaaccattgattccattcgtgatcgttttggatttcttgctgtacagaaagctagttctttattagaaaattcaagggcaatttctcgcagtagattagtcggcggacattccgctggaggattggagggtttaaaa

SEQ ID NO: 9926 - protein, 471 aa, Streptococcus agalactiae
MGYVDYSKEPRSDIAFVDMKSFYASIECVERGLHPLHTSLCVMSRADNSAGLILASSPMFKKVFGKGNVGRAYDLPFDVHTRKFNYYRAKISGLPTDAKFVSFIENWAKRTFIVPPRMDLYIQKNLEIQKVFQNYADPTDILPYSIDEGFIDLTSSLNYFVEDKSLSRKDKLDVVSAKIQHDIWEKTGVYSTVGMSNANPLLAKLALDNEAKTTATMRANWSYEDVETKVWNIPKMTDFWGIGSRTEKRLNKLGIYSIKELANCDPTILKKEFGVIGVQHWFHANGIDESNVHEPYRPKAVGIGNSQVLHKDYTRQSDIELVLREMAEQVAIRLRRRHKKATVVAINVGYSNFENKKSINVQRKINPNNRTLVFQDEVVSLFRSKYDGGAVRSIAVRYDGLVDENFAVISLFDDFEESEKEEKLETTIDSIRDRFGFLAVQKASSLLENSRAISRSRLVGGHSAGGLEGLK

SEQ ID NO: 9927 - DNA, 294 bp, Streptococcus agalactiae
atgaaattttttcaaaagaaaaaacaaaaccaggatcaattcaaacgactgattcatcgactatcagagatgtcagatagtgaactaaccaaagtagaacaactcctagatgtggtttttgatacaaattttaagcctgatacgagcgttgaattatctcaaagcgatataactgacgaggatcaaagtcttgataggtcaatccaggaagcgaaaaataaacttcacacggaacaattggaaaaaaacattgagaggtttagacaaggtaggcgagagagcaataataacaaa

SEQ ID NO: 9928 - protein, 98 aa, Streptococcus agalactiae
MKFFQKKKQNQDQFKRLIHRLSEMSDSELTKVEQLLDVVFDTNFKPDTSVELSQSDITDEDQSLDRSIQEAKNKLHTEQLEKNIERFRQGRRESNNNK

SEQ ID NO: 9929 - DNA, 6822 bp, Streptococcus agalactiae
atgaatcaagaagtcttactacaaatgatgagagccactattcctcgtgatagagccttgcttgaggcatttttatattaccaagcagagcattttgatgaggagtgggatagtcttattcatcagtttatgaccaataggcaagaaataaataagtctgttcaagtacttcactttgagacagatgtttcagcttttgtccaggctagtccttatgatactgctcatgatctattgacctatacacaagttttcggccaaagtggtcttcaaaaactagataaactatcgccgtctgaaaaaaacttggtgatagaagtggccttgttcaatctggccactcgttttcaattattggattccaatggacactaccaaaccatatcgccggattcactcttacaaaagagtaggggagctaatttggtcaatgtgtatcgtgtggctaataatttagcggatcgtattagtcgagatattgaacagtttctcttaacttacgagcctgagcttgaaactagagctgatgaaactgttctagaaaatgaagaaactgttgatgagcacaaaacaagtgttcatcaagcaatatcttttcgagaagagggctctctggttattgctagtttggatgtagatttgtctcaactagatgttcaaataggaaaaaccagtcatctgccagcttatgaagagttatccttacgacgtaaatttgagattctaacatattttgaccaaattcgaaatgaacgttccaaagtcccaagttttagacgaggtgattttgacacagagatggaaatgacaccagtctttgatggcgaggaattacttacttatctcgaagctgatggcagtccctatgagctgaaacgaacgctgactacagtcgaagaaaaggaattagaaaaaattggacaagccattaggatagaaaatcaagaaaaattgactcagctagggattgatttatctcagtttgacccagaccgagtcggtattttattggatgcagcaggtcgttttcgtttaaaaaatgcagaccttgctttactaggtggttatcccaaagcctcggtaactcaactagcccttgcgacagaactactccaaatgggactaagtcatgaaaaggttgaatttttctttggtagccagctttccattgaagagctgcgacaagttgcctacgcctttttataccaagaactcagcagagaagatgcggagcaatttgaaaaagataaaggtaatcagccagatttaactctcagagattggaaaagcaagctagagaaagctgagggaaaagaagtagttgatgaagaattcgcggaaaatccactggttcagagagtattggacacttatcctctggggtcattggtttcctataagggacaggactttgaggtcatgtcggtcagcgatgctcgattgaacggtttgattcggattgagttagtcaatgacttttcggatatcattgaacaaaatccagttctttatgtgaggacctgggaagaagtcagtcaggcacttcatcagccaaaggcagaaccacaaacagagttagaagaagcggaccaagaattaaacctattctcatttctggaagaggagccagttcagagtattggactattggaaccagatgattcagaaaatggtcataacgatactgatcttgaagaaacagataatcaaattcctgaagaggaagtcgtcgaaacaattccagagattccagtaacggacttttattttccagaagatttgacggacttttatcctaagactgctagagataaggttgagacaaacattgtggccattcgtttggtaaaaaatctagaagtagagcaccgcaatgcttcaccaagtgaacaagaactccttgccaagtatgtaggctggggtggactagccaatgaattttttgatgactataatccaaaattttctaaggaacgagaagaactgaagagcctagtcacagataaagagtattcggatatgaaacagtcctccctgacagcctattacacagacccatccctgatccgtcagatgtgggataagttggaaagagatggctttacaggtggcaaaatcctagatccttccatgggaacagggaatttctttgcggctatgccaaaacacttaagagaaaagagtgagttgtatggcgtagagttagatactattacaggagctattgccaaacaccttcatcccaatagtcatattgaaattaagggatttgagacggtggcttttaacgacaatagttttgatttggtgatttcaaatgtgccctttgccaatatacgaattgcggataataggtacgataggccttacatgattcatgactactttgtcaaaaagtcacttgatttgcttcatgatggtggacaagtagcgattatctcttccacaggaactatggataagcgaacagaaaacatcttacaagatattcgtgagacaactgaatttcttggtggggttcgactgcctgactctgcctttaaggccattgcaggaacgagtgtcacaacggatatgttattcttccagaaacacttagacaagggatatgtggcagacgatttagccttttcaggttccattcgctatgacaaggatagtcgcatttggctcaatccttattttgatggagaatacaatagccaggtgctaggaacctacgaggtcaggaattttaacggaggaacactttctgttaaggggactagtgatgacttgattgcaagtgttgaaacagctctaaatcacgttaaggccccaagagagattgatagaaatgaggtcatcattaacccagatgtgttgaccaaacaagtcaatgatacctccattccagctgaaatgagggaaaatctaggtcagtacagttttggttatcaggggtctacagtttactatcgagataacaaaggcattcgagtcggaaccaagacggaagaaatcagttactatgtcgatgaagagggcaacttcaaagcatgggacaccaaacattctcaaaagcagattgatcgctttaatgccttagaagtgactgataacactgctctggatgtctatgtgaccgatgatgcagccaaacgtggtcagtttaaggggtattataaaaagacagttttctatgaagctccattgtcttataaagaagtggcacgtatcaaaggaatggtcgatattcgcaatgcctaccaagaagttattgccattcaacgctattatgactatgataaggagacctttaaccacttgttaggcaaactcaatcgtacctatgatagctttgtcaaacactatgggtatttgaatagtgctgtgaaccgcaatctttttgatagtgatgataagtattcgcttcttgctagtttggaagatgaaagtctggatccaagtggaaagtctgttatctatactaaatcccttgcctttgagaaggctctagtgcgtcctgaaaaagaggttaaaaaggtgcatactgcccttgatgccttaaattcgagcttggctgacggacgaggtgttgatttcgcttatatgatgtctatctatcaggttgaatcgcagatgaccttgattgaggagttaggcgacctcattatgcctgatcctgagaagtatttgaatggagaattgacctatgtttctcgccaagactttctttcaggggatgtcgtcactaagttagaagtggtagatctattcgtcaaacaagacaatcaggactttaactggtcacattatgcgggacttctagaagctatcaaaccagcccgtattactttggcagacattgattatcgaatcggttcacgctggattcctctggctgtttatggaaaatttgcccaagaaacctttatggggaaagcctatgaactgtcagaccaagaagtagcgacagtcctagaagtcagtcccattgacggggttatcacttaccaatctaagtttgcctacacctattccaacgcaacggataggagtttaggtgtccctgcttcacgctatgatagtggtcgaaaaatctttgaaaatctcctgaattccaatcaaccaaccatcacaaaacaagttgtcgaaggggataagaaaaagaatgtgacggatgtagagaaaacaacggtcctgcgtgccaaggaaacacacctacaagaactctttcaaggttttgtagcaaagtatccagaagtccaacaaatgattgaagacacctataataggctctacaatcgtacggtatcaaagtcctatgatggtagtcatttaaccattgatggacttgctcagaatatctccttacgtcctcaccaaaagaatgccattcaacgaattgtcgaggaaaaacgtgctctactagctcatgaagttggttcaggtaaaacacttaccatgcttggggcaggattcaaactgaaagaactcggaatggtacataaaccactttatgtggtgccgtctagtctgactgctcagtttggtcaagaaatcatgaaatttttccctaccaagaaagtctatgtgactactaagaaagactttgccaaagccaaacgcaagcagtttgtgtcccgtattattacaggggactatgatgccattgtcattggggattcacaatttgagaagataccgatgagtcgtgaaaaacaggtcacctatatcaatgacaaacttgagcaactccgagaaatcaagctaggaagtgacagtgattacacggtgaaagaagcggaacgttcgattaagggattagaacaccagttggaagaactccaaaaactagagcgagatacctttattgagtttgaaaaccttggaattgattttctttttgtggatgaggctcatcacttcaagaatatccgtccaatcactggacttgggaatgtagctggaatcaccaacacaacttctaaaaagaacgtggatatggagatgaaggtgagacaagtacaggcagagcatggagatagaaatgtcgtttttgcgacaggaacaccagtttctaactctattagtgaacttttcaccatgatggattacattcaacctgatgtcttggaacgatacctggtatcaaattttgactcctgggttggggcttttgggaatatcgaaaactccatggaactagccccgacaggagataagtaccaacccaagaaacggttcaagaaatttgtcaaccttcctgaactcatgcgaatctacaaggaaactgccgatattcagacctcagacatgcttgatttaccagtaccggaagctaagattattgcggtggaaagcgagttaacgcaagctcagaaatactatttggaagagctggtaaagcgttcagacgctatcaagtcaggtagtgttgatccaagtagagataacatgcttaaaatcacaggagaagccagaaaactagctattgatatgcggttgattgaccctacttactccttatcggataatcagaaaatccttcaagtagtcgataatgtcgagcggatttaccgtgatggagctggagacaaagccactcagatgattttctcagatattggaacccctaaaagtaaggaagaagggtttgatgtctacaatgaacttaaggacttgtttgtcgatcgagggataccaaaagaagaaattgcctttgtccatgatgccaatactgatgagaagaaaaactctctgtcacgcaaggtcaatagtggagaagtacggattctcatggcttctacggaaaaagggggaacaggattaaacgtccaatctcgcatgaaagctgtccactatttagacgttccctggaggccctcagacattgtccagcgaaatggacgactaattcgacaaggaaacatgcaccaggaggtagatatttatcactatattactaaagggagctttgacaattacctctggcagacgcaggagaataagctaaagtatatcacccagataatgacctcaaaagatcctgtgagatcagctgaagacattgatgaacaaaccatgaccgcctcagactttaaggcattggcaactgggaacccttatctcaaactcaaaatggagttggaaaatgaactgacagttttagagaatcaaaaacgagcctttaatcgctccaaagacgagtatcgccataccatttcctatagcgagaagcacctccctattatggaaaaacggttgagtcaatatgataaagatattgcccaatctttggcaaccaagtcgcaagattttgtcatgcgatttgacaatcaagcaatggataatcgtgctgaagctggggactatctgcgaaaactcattacctataaccgctcagagaccaaggaagtcaggacacttgccagctttagaggatttgatttaaaaatgactacacgaggtgctagtgagcccttaccagaaaccatttctttaatgattgtaggtgataaccagtatactgtcgcccttgatttgaaatcagacgtgggaaccattcaacggattagtaatgccattgaccatattatagatgaccaagaaaagacgcaagagctggtaaaggatttaaaagataagctacgagtagccaaagtagaagttgataaagtctttccaaaggaagaggactatcagcttgtaaaggctaagtatgatgttttagctcccttggttgaaaaagaagcagagattgaagagatagatgcagctttggccaagtttagtgaagatacaacaccccaaaagaagcaacaaatagcactcgagata

SEQ ID NO: 9930 - protein, 2274 aa, Streptococcus agalactiae
MNQEVLLQMMRATIPRDRALLEAFLYYQAEHFDEEWDSLIHQFMTNRQEINKSVQVLHFETDVSAFVQASPYDTAHDLLTYTQVFGQSGLQKLDKLSPSEKNLVIEVALFNLATRFQLLDSNGHYQTISPDSLLQKSRGANLVNVYRVANNLADRISRDIEQFLLTYEPELETRADETVLENEETVDEHKTSVHQAISFREEGSLVIASLDVDLSQLDVQIGKTSHLPAYEELSLRRKFEILTYFDQIRNERSKVPSFRRGDFDTEMEMTPVFDGEELLTYLEADGSPYELKRTLTTVEEKELEKIGQAIRIENQEKLTQLGIDLSQFDPDRVGILLDAAGRFRLKNADLALLGGYPKASVTQLALATELLQMGLSHEKVEFFFGSQLSIEELRQVAYAFLYQELSREDAEQFEKDKGNQPDLTLRDWKSKLEKAEGKEVVDEEFAENPLVQRVLDTYPLGSLVSYKGQDFEVMSVSDARLNGLIRIELVNDFSDIIEQNPVLYVRTWEEVSQALHQPKAEPQTELEEADQELNLFSFLEEEPVQSIGLLEPDDSENGHNDTDLEETDNQIPEEEVVETIPEIPVTDFYFPEDLTDFYPKTARDKVETNIVAIRLVKNLEVEHRNASPSEQELLAKYVGWGGLANEFFDDYNPKFSKEREELKSLVTDKEYSDMKQSSLTAYYTDPSLIRQMWDKLERDGFTGGKILDPSMGTGNFFAAMPKHLREKSELYGVELDTITGAIAKHLHPNSHIEIKGFETVAFNDNSFDLVISNVPFANIRIADNRYDRPYMIHDYFVKKSLDLLHDGGQVAIISSTGTMDKRTENILQDIRETTEFLGGVRLPDSAFKAIAGTSVTTDMLFFQKHLDKGYVADDLAFSGSIRYDKDSRIWLNPYFDGEYNSQVLGTYEVRNFNGGTLSVKGTSDDLIASVETALNHVKAPREIDRNEVIINPDVLTKQVNDTSIPAEMRENLGQYSFGYQGSTVYYRDNKGIRVGTKTEEISYYVDEEGNFKAWDTKHSQKQIDRFNALEVTDNTALDVYVTDDAAKRGQFKGYYKKTVFYEAPLSYKEVARIKGMVDIRNAYQEVIAIQRYYDYDKETFNHLLGKLNRTYDSFVKHYGYLNSAVNRNLFDSDDKYSLLASLEDESLDPSGKSVIYTKSLAFEKALVRPEKEVKKVHTALDALNSSLADGRGVDFAYMMSIYQVESQMTLIEELGDLIMPDPEKYLNGELTYVSRQDFLSGDVVTKLEVVDLFVKQDNQDFNWSHYAGLLEAIKPARITLADIDYRIGSRWIPLAVYGKFAQETFMGKAYELSDQEVATVLEVSPIDGVITYQSKFAYTYSNATDRSLGVPASRYDSGRKIFENLLNSNQPTITKQVVEGDKKKNVTDVEKTTVLRAKETHLQELFQGFVAKYPEVQQMIEDTYNRLYNRTVSKSYDGSHLTIDGLAQNISLRPHQKNAIQRIVEEKRALLAHEVGSGKTLTMLGAGFKLKELGMVHKPLYVVPSSLTAQFGQEIMKFFPTKKVYVTTKKDFAKAKRKQFVSRIITGDYDAIVIGDSQFEKIPMSREKQVTYINDKLEQLREIKLGSDSDYTVKEAERSIKGLEHQLEELQKLERDTFIEFENLGIDFLFVDEAHHFKNIRPITGLGNVAGITNTTSKKNVDMEMKVRQVQAEHGDRNVVFATGTPVSNSISELFTMMDYIQPDVLERYLVSNFDSWVGAFGNIENSMELAPTGDKYQPKKRFKKFVNLPELMRIYKETADIQTSDMLDLPVPEAKIIAVESELTQAQKYYLEELVKRSDAIKSGSVDPSRDNMLKITGEARKLAIDMRLIDPTYSLSDNQKILQVVDNVERIYRDGAGDKATQMIFSDIGTPKSKEEGFDVYNELKDLFVDRGIPKEEIAFVHDANTDEKKNSLSRKVNSGEVRILMASTEKGGTGLNVQSRMKAVHYLDVPWRPSDIVQRNGRLIRQGNMHQEVDIYHYITKGSFDNYLWQTQENKLKYITQIMTSKDPVRSAEDIDEQTMTASDFKALATGNPYLKLKMELENELTVLENQKRAFNRSKDEYRHTISYSEKHLPIMEKRLSQYDKDIAQSLATKSQDFVMRFDNQAMDNRAEAGDYLRKLITYNRSETKEVRTLASFRGFDLKMTTRGASEPLPETISLMIVGDNQYTVALDLKSDVGTIQRISNAIDHIIDDQEKTQELVKDLKDKLRVAKVEVDKVFPKEEDYQLVKAKYDVLAPLVEKEAEIEEIDAALAKFSEDTTPQKKQQIALEI

SEQ ID NO: 9931 - DNA, 588 bp, Streptococcus agalactiae
atgtcaaaaaaagagattctactcgattttatagaaaagaacaatggcattgtcacaaacaaagattgtaaagcactaggtattccaacaatatatctgacaagactagagaaagaaggcattatcttccgagttgaaaaaggtattttcctaacccaaaacggagactatgatgaatactacttctttcaatatcgttttcctaaggctattttctcttatatttcggcactgtatctacaacagtttacagatgaaattccacaatattttgatgtgacagttcctagaggctaccgctttaatactcctccagctaatctaaacattcactttgtctctaaagaatacagcgagctgggaatgactactgtacctactcctatgggaaacaacgtaagggtatatgattttgaacgtattatttgtgattttgtaatacatcgagaaaagattgattccgaactctttgtcaagacacttcaatcttatgggaactatcctaaaaaaaatctagcaaaactctatgaatatgcgacaaaaatgaatactttagaaaaagttaaacaaactctggaggttctaata

SEQ ID NO: 9932 - protein, 196 aa, Streptococcus agalactiae
MSKKEILLDFIEKNNGIVTNKDCKALGIPTIYLTRLEKEGIIFRVEKGIFLTQNGDYDEYYFFQYRFPKAIFSYISALYLQQFTDEIPQYFDVTVPRGYRFNTPPANLNIHFVSKEYSELGMTTVPTPMGNNVRVYDFERIICDFVIHREKIDSELFVKTLQSYGNYPKKNLAKLYEYATKMNTLEKVKQTLEVLI

SEQ ID NO: 9933 - DNA, 240 bp, Streptococcus agalactiae
atgaatcaaaaactaacaggctttgtttacggagtggacgccagctccatgttctcccaggccatgtctctattacaaaaaggcttgattgcagtaggagcctttcttgtagtcatgggcattatcaacctttcaaccaacattaaagatggtgggccaggcgtccgaaatgccattttagaaattgttggtggtgtcatggtgggagccgcaggtgcttttgtgacacagattaccatt

SEQ ID NO: 9934 - protein, 80 aa, Streptococcus agalactiae
MNQKLTGFVYGVDASSMFSQAMSLLQKGLIAVGAFLVVMGIINLSTNIKDGGPGVRNAILEIVGGVMVGAAGAFVTQITI

SEQ ID NO: 9935 - DNA, 486 bp, Streptococcus agalactiae
atgtcatctgaacaacaagaacgtcaagcgatgcaatacgtagaaagaagtagtttattgacagtcagaaccctcttaaaactcttagaatggtcggctaggcaagccttagctcaagattcagcttataagattggggttcaaaaaatggaagaactccttcaaagtccttacgccattgaagcgattgatgttagtaaagacatactggataagccaatcgatgtggagaaatttaaggagttgatggagtcagaaaaactgccaatcgcaattagttggcaaaaagactatctctacttttatgccaaggataagaccttgctcgatcatcacttggatgaattgttgaagaaactgatgtctaatccagagaagctagaaggtttaacctttgataaaaccttggaccaagagatagaactggccaaagagaaaattagagtgacagaactttcggcagtaaaaaccaaggaggtgaccttg

SEQ ID NO: 9936 - protein, 162 aa, Streptococcus agalactiae
MSSEQQERQAMQYVERSSLLTVRTLLKLLEWSARQALAQDSAYKIGVQKMEELLQSPYAIEAIDVSKDILDKPIDVEKFKELMESEKLPIAISWQKDYLYFYAKDKTLLDHHLDELLKKLMSNPEKLEGLTFDKTLDQEIELAKEKIRVTELSAVKTKEVTL

SEQ ID NO: 9937 - DNA, 582 bp, Streptococcus agalactiae
atgataaggatagtgttgttttatctagccatacagcttaacggtcttctggtgagtttattcctgaaagagtatctgacaatagagggtatagtcttgctacaattggtcctattaagtgtgacttgcttagagattgcccgtcataaaactgttccattaaaaattgtgggcgtacaaaatcgcctaagttggttgcttcttggctttgtggctatggttgcttttgcagtcttcatcagtttcctatttccagttcagactaggaatcaagcagtattggtacaagtaggaaaacaggttcctcctattatctttttattgtttctggtcaatgcaagtattcttgaagagattgtttacaggcaattgctgtgggaaaaattgacattcccttttgaacaaataggcgtgaccagttttctctttgttctatcccatggacctaatcagttagggagttggctcatctatagctgtcttggcttgaccttggctgttgttcgattgaaaactgattgtatgacggcaatcgccttacatttactttggaatagtttggcttatgtcgtaactttcttg

SEQ ID NO: 9938 - protein, 194 aa, Streptococcus agalactiae
MIRIVLFYLAIQLNGLLVSLFLKEYLTIEGIVLLQLVLLSVTCLEIARHKTVPLKIVGVQNRLSWLLLGFVAMVAFAVFISFLFPVQTRNQAVLVQVGKQVPPIIFLLFLVNASILEEIVYRQLLWEKLTFPFEQIGVTSFLFVLSHGPNQLGSWLIYSCLGLTLAVVRLKTDCMTAIALHLLWNSLAYVVTFL

SEQ ID NO: 9939 - DNA, 231 bp, Streptococcus agalactiae
atgaatgaacgattttgggacaatttagaaatcattctggctgaaaaagacctcacttgggcagaactagctcgcaaagtattcaacggtcaatatgtttatccaagtgaatttaatcgcctctatcaaaaattacggcattacaaatctaatcgtctgatgccacaaataagatgggttgagcgtattgttctagtcttagatattgattatgaagatttatttaagagg

SEQ ID NO: 9940 - protein, 77 aa, Streptococcus agalactiae
MNERFWDNLEIILAEKDLTWAELARKVFNGQYVYPSEFNRLYQKLRHYKSNRLMPQIRWVERIVLVLDIDYEDLFKR

SEQ ID NO: 9941 - DNA, 93 bp, Streptococcus agalactiae
atgatttggtggatactaggtggaatctatctgatttctatcatcattttgattgttgaaatcatccgtgcaccagaaatggatgatcatata

SEQ ID NO: 9942 - protein, 31 aa, Streptococcus agalactiae
MIWWILGGIYLISIIILIVEIIRAPEMDDHI

SEQ ID NO: 9943 - DNA, 363 bp, Streptococcus agalactiae
atggcattaaacattgaaaatattattgctgaaattaaagaagctacaattcttgaacttaacgatcttgtaaaagctatcgaagaagaatttggtgtaactgctgctgctcctgtagctgctgccgctgctggtggtgaagctgctgctgctaaagactcatttgacgttgaattaacagctgctggagacaaaaaagttggcgttatcaaagttgttcgtgaaatcacaggcgaaggtcttaaagaagctaaagctatcgttgataacgcaccatcagttatcaaagaaggtgcttcagaagcagaagctaacgaaatcaaagaaaaacttgaagctgcaggtgcttcagttactcttaaa

SEQ ID NO: 9944 - protein, 121 aa, Streptococcus agalactiae
MALNIENIIAEIKEATILELNDLVKAIEEEFGVTAAAPVAAAAAGGEAAAAKDSFDVELTAAGDKKVGVIKVVREITGEGLKEAKAIVDNAPSVIKEGASEAEANEIKEKLEAAGASVTLK

SEQ ID NO: 9945 - DNA, 1023 bp, Streptococcus agalactiae
gtgctgggctttacttcggtgttccatttattattttctgctatatttatcacaaactacgttacaagaaatggtgatcttatgggaagatttaaagaacttttagagagtaaaaaaactctcatcctacatggtgccttggggaccgagcttgagagtagaggttgtgatgtttctgggaaactttggtcagccaaatatctgattgaggatccagcagctattcagaccattcatgaagattatattcgtgctggcgctgatattgtgacgacatcaacttatcaggcgactttacaaggactagctcaagttggtgtctctgaaagtcagacagaagatttgattcgcttgactgttcagttggcaaaagctgcgcgtgagcaagtttggaaaagtttgacaaaagaagaaaaatcagagagaatctatcctttgatttctggggatgttggtccctacgctgcctttttagcggatggctctgagtacactggactctacgatattgataagcaaggtcttaaaaacttccatcgccatcgtattgagcttcttttagatgagggtgttgacattctggcacttgaaaccattccaaacgctcaggaggctgaggctcttattgagctacttgccgaggatttccctcaggttgaggcttatatgtcattcacctctcaagatggtaagaccatctcagatggtagtgctgttgcagacttggcgaaagctattgatgttagcccacaggtcgtggcgctgggcattaactgttcaagtccatcgttagttgctgatttcttgcaagcaatagcagagcagactaacaagcctcttgtgacctatccaaactctggagaggtttatgatggggcaagccaatcttggcaatctagccctgatcattcacacaccctacttgaaaatacaagtgactggcaaaaacttggcgcccaagttgtcggaggttgttgccgaactagaccagctgatattgctgacctctctgcacatttaaaa

SEQ ID NO: 9946 - protein, 341 aa, Streptococcus agalactiae
MLGFTSVFHLLFSAIFITNYVTRNGDLMGRFKELLESKKTLILHGALGTELESRGCDVSGKLWSAKYLIEDPAAIQTIHEDYIRAGADIVTTSTYQATLQGLAQVGVSESQTEDLIRLTVQLAKAAREQVWKSLTKEEKSERIYPLISGDVGPYAAFLADGSEYTGLYDIDKQGLKNFHRHRIELLLDEGVDILALETIPNAQEAEALIELLAEDFPQVEAYMSFTSQDGKTISDGSAVADLAKAIDVSPQVVALGINCSSPSLVADFLQAIAEQTNKPLVTYPNSGEVYDGASQSWQSSPDHSHTLLENTSDWQKLGAQVVGGCCRTRPADIADLSAHLK

SEQ ID NO: 9947 - DNA, 1224 bp, Streptococcus agalactiae
atggctgggaatcgtaataacgatatgaatgtctattgttcattttgtggcaaaagccaagatgaagtaaaaaaaattattgcaggtaatggtgttttcatttgtaatgaatgtgtggccttatcacaagaaattattaaggaagaattagctgaggaagtactggctgatttagcagaagtaccaaaacctaaggaactattagaaatattaaatcaatatgttgtagggcaagatcgtgctaaacgtgctttagcagttgctgtctacaatcattacaagcgtgttagttataccgagagtagtgacgatgatgtagatttgcaaaaatccaacattttgatgattggtccaactggctcaggaaaaaccttcttagcacaaacactggctaaaagccttaatgtaccgtttgctattgcagatgcgacttcattgaccgaagcaggatacgttggagaagatgttgagaatattcttcttaaattgattcaagctgctgattataatgtcgaacgtgctgagcgtggtattatctacgttgatgaaatagataaaattgctaagaaaggcgaaaatgtttctatcacacgtgatgtgtctggtgaaggtgtacagcaagcccttcttaaaattattgagggtacggtagcaagtgttcccccacagggtgggcgtaaacatcctaaccaagaaatgattcaaattaataccaagaacatcctttttattgtcggtggtgcttttgatggtattgaagaccttgtgaagcaacgtttaggcgaaaaagttattggttttggacagacaagccgtaaaattgatgacaacgcttcttatatgcaagagataatttctgaggatattcaaaagtttggactgattccagagtttattggccgtttaccagtagttgcagcgttagaacttcttactgcagaagatctggttcgtattctgacagaaccacgcaatgctttggttaaacaataccaaaccttattatcttatgatggtgtagaattggaatttgaccaggatgctctattggctatcgctgataaggctatcgagcgcaagactggtgcacgtggtttacgttctattattgaagaaacgatgcttgatatcatgtttgaaattccaagccaagaagatgtaacaaaagttcgtatcacaaaggctgctgttgagggtactgacaagcctgttttagagacggct

SEQ ID NO: 9948 - protein, 408 aa, Streptococcus agalactiae
MAGNRNNDMNVYCSFCGKSQDEVKKIIAGNGVFICNECVALSQEIIKEELAEEVLADLAEVPKPKELLEILNQYVVGQDRAKRALAVAVYNHYKRVSYTESSDDDVDLQKSNILMIGPTGSGKTFLAQTLAKSLNVPFAIADATSLTEAGYVGEDVENILLKLIQAADYNVERAERGIIYVDEIDKIAKKGENVSITRDVSGEGVQQALLKIIEGTVASVPPQGGRKHPNQEMIQINTKNILFIVGGAFDGIEDLVKQRLGEKVIGFGQTSRKIDDNASYMQEIISEDIQKFGLIPEFIGRLPVVAALELLTAEDLVRILTEPRNALVKQYQTLLSYDGVELEFDQDALLAIADKAIERKTGARGLRSIIEETMLDIMFEIPSQEDVTKVRITKAAVEGTDKPVLETA

SEQ ID NO: 9949 - DNA, 492 bp, Streptococcus agalactiae
atgacaaagcaaataattgccatttgggctgaagatgaagaccatttgattggagttaatggcggtttaccatggaggcttcctaaagagttacatcacttcaaagaaacgaccatggggcaggctttgcttatgggacgaaagacctttgatggaatgaaccgtcgtgttttacctggtagagagacaatcatcttaacaaaagatgaacaattccaagcagatggagtgacagtcctaaatagtgttgaacaagttataaaatggtttcaggaacataataagaccttatttattgtaggtggtgcaagtatttataaagcatttctgccttattgtgaagcaatcataaaaactaaagttcatggaaaatttaaaggtgatacctattttcctgatgttaatctatctgagtttaaagttatctctagagattattttgaaaaggatgagcagaatgctcatgcttttactgtgacatattttgaaaaa

SEQ ID NO: 9950 - protein, 164 aa, Streptococcus agalactiae
MTKQIIAIWAEDEDHLIGVNGGLPWRLPKELHHFKETTMGQALLMGRKTFDGMNRRVLPGRETIILTKDEQFQADGVTVLNSVEQVIKWFQEHNKTLFIVGGASIYKAFLPYCEAIIKTKVHGKFKGDTYFPDVNLSEFKVISRDYFEKDEQNAHAFTVTYFEK

SEQ ID NO: 9951 - DNA, 561 bp, Streptococcus agalactiae
atgctaatcctattaccaatcaccgctgtctatagtcacaaccacttcggattacaagcagcacttggtacctcaatattcgtcacttctttatttttgatgtttttatcatcaagtatttaccactccatgacttataacagtcttcaaaaatatgttctacgcatgattgatcactctatgatttatattgctattgcaggtagttatactcctgtcgcattgtcacttattggcggctggttaggatatctcatcatttttttacaatgggggattacattatttggtatcctttataaaatcttcgctcccaaaatcaatgataaatttagccttgtactttacctcattatgggatggctggttatctttattttccctgctattatcacaaaaactggaccagctttttggggattactcttggctggtggtatttgctatactatcggtgcactcttttatgctcgcaaacgtccttatgatcacatgatttggcacctttttattctattagcttctattttacaatacattggaattgtctacttcatgcta

SEQ ID NO: 9952 - protein, 187 aa, Streptococcus agalactiae
MLILLPITAVYSHNHFGLQAALGTSIFVTSLFLMFLSSSIYHSMTYNSLQKYVLRMIDHSMIYIAIAGSYTPVALSLIGGWLGYLIIFLQWGITLFGILYKIFAPKINDKFSLVLYLIMGWLVIFIFPAIITKTGPAFWGLLLAGGICYTIGALFYARKRPYDHMIWHLFILLASILQYIGIVYFML

SEQ ID NO: 9953 - DNA, 438 bp, Streptococcus agalactiae
atggagaatcctcttcaaaaagcacgaatacttgttaatcaacttgaaaagtatttagatcattatgcaaaagaatatgatgttgaacatttagcgggtccacaaggacacctagtgatgtatctctataaacatcctgataaggatatgtctataaaagctgttgaagaaatcttacacatttctaagtctgtagcttctaatttggtaaaacggatggaaaaaaatggttttattgcgattgtaccatctaagacagataagcgtgtaaaatatctttatttgactcacttaggtaaaaaaaaggctacacaatttgaaattttcttagaaaaattgcatagtactatgttagcaggtattactaaagaagagattcgtaccaccaaaaaggttattaggacattagctaaaaatatggcaatggaaaatcttgat

SEQ ID NO: 9954 - protein, 146 aa, Streptococcus agalactiae
MENPLQKARILVNQLEKYLDHYAKEYDVEHLAGPQGHLVMYLYKHPDKDMSIKAVEEILHISKSVASNLVKRMEKNGFIAIVPSKTDKRVKYLYLTHLGKKKATQFEIFLEKLHSTMLAGITKEEIRTTKKVIRTLAKNMAMENLD

SEQ ID NO: 9955 - DNA, 507 bp, Streptococcus agalactiae
atgaaatggttcccacttgttggaggtataattgccttattagctggcttctatctctttataaatcctgtaacggttgttgcaactctgggttggttcattgctttatttatctttatttatggcatttcaaatttagtacgctacttgcaagctgattcttatcaccgtagcccttggtatctggttcagagtatccttgctattatttttggtatcattttactatccagctcagcaatgtcactttcaaatactgtcatgactattttagcatactggctactggtatctggtattttacgacttttgggtggtttccaaatgcaaaaaattaatttcccaggtgccaaatcctataaacgttcggcttatattgcactcattttaggtattattttactggttcaacctaccttatcagcagccatcattggaagatttgtagcctttatattaatagcaattggagcttcggctatttacacttttactcgtattaattat

SEQ ID NO: 9956 - protein, 169 aa, Streptococcus agalactiae
MKWFPLVGGIIALLAGFYLFINPVTVVATLGWFIALFIFIYGISNLVRYLQADSYHRSPWYLVQSILAIIFGIILLSSSAMSLSNTVMTILAYWLLVSGILRLLGGFQMQKINFPGAKSYKRSAYIALILGIILLVQPTLSAAIIGRFVAFILIAIGASAIYTFTRINY

SEQ ID NO: 9957 - DNA, 1206 bp, Streptococcus agalactiae
atgagattaaattatttgccttctgagtttcagaaggctttaccaatattaaaaaagataaaaaaagccggttatgaagcatactttgtaggtggtagtgttcgggatgttttacttgaccgtccaattcatgatgttgatatagcaacgtcatcttatccagaagaaacaaagcagatttttaaaaggacagttgatgttggtattgaacatggaacagtcttagtattggaaaaaggtggtgaatatgagattaccacttttaggactgaggaggtttatgttgattataggcgtccgagtcaggtcaattttgttaggtcgctagaagaagatctaaaacgtcgagatttcacagttaatgcctttgctttaaatgaagatggagaagttattgatctctttcatggattggatgatttagataatcaccttcttagagcagtaggactcgccagtgagcgttttaatgaagatgctcttcgaattatgcgtggtttgcgtttttctgctagtctaaattttgatatcgaaacaacaacttttgaggcaatgaaaaagcacgcgtcattattggagaaaatatctgttgagcgttcttttattgaatttgataaacttctattagcaccttattggcgtaaaggaatgctggcactaatagatagtcatgcttttaattatctaccatgcttaaaaaatagggaattacaattaagcgcctttttgtcccagttagataaagattttttatttgagacatcagaacaagcttgggcatcactcatcttgagtatggaagttgaacacacaaagacttttttaaaaaaatggaagacatcaactcactttcaaaaagatgttgagcatatagtggatgtttatcgtattcgtgaacaaatgggattgactaaagaacatctttatcgttatggaaaaactataataaaacaagcggaaggtattcgcaaagcaagaggcttgatggttgatttcgaaaaaatagaacaactagatagtgagttagcaatccatgataggcatgagatagttgtcaatggtggcaccttaatcaagaaattaggaataaaacctggtccacagatgggagatattatctctcaaattgaattagccattgttttaggacaactgattaatgaagaagaggctattttacattttgttaagcagtacttgatggat

SEQ ID NO: 9958 - protein, 402 aa, Streptococcus agalactiae
MRLNYLPSEFQKALPILKKIKKAGYEAYFVGGSVRDVLLDRPIHDVDIATSSYPEETKQIFKRTVDVGIEHGTVLVLEKGGEYEITTFRTEEVYVDYRRPSQVNFVRSLEEDLKRRDFTVNAFALNEDGEVIDLFHGLDDLDNHLLRAVGLASERFNEDALRIMRGLRFSASLNFDIETTTFEAMKKHASLLEKISVERSFIEFDKLLLAPYWRKGMLALIDSHAFNYLPCLKNRELQLSAFLSQLDKDFLFETSEQAWASLILSMEVEHTKTFLKKWKTSTHFQKDVEHIVDVYRIREQMGLTKEHLYRYGKTIIKQAEGIRKARGLMVDFEKIEQLDSELAIHDRHEIVVNGGTLIKKLGIKPGPQMGDIISQIELAIVLGQLINEEEAILHFVKQYLMD

SEQ ID NO: 9959 - DNA, 1923 bp, Streptococcus agalactiae
atggatttaaaagcaaccagtaaagaggctgcaattgatgaaatgattacaaaattagttgacacaggtgttgtgacaaactttgctatttttaaagatggtatcatgaagcgtgaggcacaaacatcaactggattaggtgatggtatcgctatgccacatagtaaaaatgctgccgttaaagaagctactgtcctttttgcaaaatctgcatcaggtgttgattacgaagcacttgatggacagccaactgatttattctttatgattgctgcgccagatggtgctaatgatacgcatttagctgccttggcagaactatctaaatatcttttaaaagaagggttcgctgatcaattacgtcaagcaaaaacgccagatgacattattgctacttttgatagtaatagcatttctcaagaaacagtagctccacaaacagtacaatcaacaagtaaaggttcagattatattgttgcagtaacagcttgcactacgggaattgcccacacgtatatggcagaagaagctttaaagaaaaaagcagctgaaatgggtgtaggtattaaagttgaaacaaatggcgcttctggtgtaggaaataagttgacttcaagtgatattgcaagggctaagggtgttattattgcagcagataaggctgtagagatggatcgttttgatggcaaacctttggtatcacgtccggtagctgatggtattaaaaaaagtgaagacttaattaacattattctcgataataaggcacaaacctatcatgcaaaaaatcaaaatgataaacaatcaggtgaatctgatggaaaatcaggcttaggctctgctttttataaacaccttatgggtggtgtatcacaaatgttaccattcgttattggtggtggtattatgattgcgattgctttcctttttgataacatacttggtgtaccaaaagaccaattaagtaatttaggttcataccatgaaattgcagccttattcaaaaatatcggtggcgcagcatttgcatttatgttaccagtattggcaggttatatcgcttattcaatagctgaaaaaccaggactagtagctggcttcgtagctggttcaattgcatcaagtggactggcattcggtaaagtaccttttgcagaaggtgggaaagcaaccttagcattagcaggtgtgccatcaggtttcttaggggctttagtaggtggtttcttagctggtggagttatcctactacttagaaaattactttcaggtctcccaaaatcgcttgaaggtattaaatcaattcttctatacccattgttaggtgttttgattacaggtttcttgatgttgctcgtaaacattccaatggcagctatcaacacagctcttaacactttcttacaaggtttatctggtagttcagcagtcttgatgggcttactagttggtggtatgatggctgtagatatgggtgggcctgttaataaagcagcttatgtttttggtacaggtactcttgcagcaactgttgcaaatggcggctctgttgttatggcagctgtaatggctggaggaatggttccaccgttagcagtatttgtggcaactttattatttaaagataaatttaataatgaagaacgtcaatctggtctaacaaatatcgttatggggttatcttttatcactgaaggtgctattccgtttggtgctgctgacccagctcgtgcaatccctagctttattgtaggttcagccttaactggagcacttgttggtttagctggtatcaagttgatggctcctcatggagggatttttgtcatcgcattaacaagtaatcctttactttatattctatttattctaattggagcggtagtctcaggtgtactctttggcttgttccgtaaaataaaa

SEQ ID NO: 9960 - protein, 641 aa, Streptococcus agalactiae
MDLKATSKEAAIDEMITKLVDTGVVTNFAIFKDGIMKREAQTSTGLGDGIAMPHSKNAAVKEATVLFAKSASGVDYEALDGQPTDLFFMIAAPDGANDTHLAALAELSKYLLKEGFADQLRQAKTPDDIIATFDSNSISQETVAPQTVQSTSKGSDYIVAVTACTTGIAHTYMAEEALKKKAAEMGVGIKVETNGASGVGNKLTSSDIARAKGVIIAADKAVEMDRFDGKPLVSRPVADGIKKSEDLINIILDNKAQTYHAKNQNDKQSGESDGKSGLGSAFYKHLMGGVSQMLPFVIGGGIMIAIAFLFDNILGVPKDQLSNLGSYHEIAALFKNIGGAAFAFMLPVLAGYIAYSIAEKPGLVAGFVAGSIASSGLAFGKVPFAEGGKATLALAGVPSGFLGALVGGFLAGGVILLLRKLLSGLPKSLEGIKSILLYPLLGVLITGFLMLLVNIPMAAINTALNTFLQGLSGSSAVLMGLLVGGMMAVDMGGPVNKAAYVFGTGTLAATVANGGSVVMAAVMAGGMVPPLAVFVATLLFKDKFNNEERQSGLTNIVMGLSFITEGAIPFGAADPARAIPSFIVGSALTGALVGLAGIKLMAPHGGIFVIALTSNPLLYILFILIGAVVSGVLFGLFRKIK

SEQ ID NO: 9961 - DNA, 741 bp, Streptococcus agalactiae
atgctaaagtcaaagagaaaagaaattatcttatcacgacttgagcaaaataagagtgttactttagatgaattaacgtctatcttagagacttctgaatctacagttcgcagggatttagatgaacttgaatctgcaggttttttaaaaagggtgcatggtggtgctgaattaccatactcacttggccaggaattaagtaatcaagaaaaagctatcaaaaacgttcaaaaaaaattggatattgctagacaaactgcaaagctgatagcaaagcaagatgttatatttattgatgccggaactacgacagaattattaattgattttctccctcacgagcaattaacggtggtgacgaattctattcatcatgctgcaaagttagttgatagagggataaaaacaatcattatcggaggagcggttaaacattcaacagatgctagtattggccaggtagccattaatcagattaggcagataacggttgacaaagcttttctggggatgaatggtatagatgaagtttatttaactacaccagatttagaagaagctgctattaaagaagctattattaataatagtcaacaaacctttattctaatggattcatctaaaattggacaagttacatttgctaaagtgaaagagataaatgacattaatttagtaactaataagactgattcagaacttatgacaataataaaagagaaaatgaaggtgattcaagta

SEQ ID NO: 9962 - protein, 247 aa, Streptococcus agalactiae
MLKSKRKEIILSRLEQNKSVTLDELTSILETSESTVRRDLDELESAGFLKRVHGGAELPYSLGQELSNQEKAIKNVQKKLDIARQTAKLIAKQDVIFIDAGTTTELLIDFLPHEQLTVVTNSIHHAAKLVDRGIKTIIIGGAVKHSTDASIGQVAINQIRQITVDKAFLGMNGIDEVYLTTPDLEEAAIKEAIINNSQQTFILMDSSKIGQVTFAKVKEINDINLVTNKTDSELMTIIKEKMKVIQV

SEQ ID NO: 9963 - DNA, 1632 bp, Streptococcus agalactiae
atgatgaaaaaaggacaagtaaatgatactaagcaatcttactctctacgtaaatataaatttggtttagcatcagtaattttagggtcattcataatggtcacaagtcctgtttttgcggatcaaactacatcggttcaagttaataatcagacaggcactagtgtggatgctaataattcttccaatgagacaagtgcgtcaagtgtgattacttccaataatgatagtgttcaagcgtctgataaagttgtaaatagtcaaaatacggcaacaaaggacattactactcctttagtagagacaaagccaatggtggaaaaaacattacctgaacaagggaattatgtttatagcaaagaaaccgaggtgaaaaatacaccttcaaaatcagccccagtagctttctatgcaaagaaaggtgataaagttttctatgaccaagtatttaataaagataatgtgaaatggatttcatataagtctttttgtggcgtacgtcgatacgcagctattgagtcactagatccatcaggaggttcagagactaaagcacctactcctgtaacaaattcaggaagcaataatcaagagaaaatagcaacgcaaggaaattatacattttcacataaagtagaagtaaaaaatgaagctaaggtagcgagtccaactcaatttacattggacaaaggagacagaattttttacgaccaaatactaactattgaaggaaatcagtggttatcttataaatcattcaatggtgttcgtcgttttgttttgctaggtaaagcatcttcagtagaaaaaactgaagataaagaaaaagtgtctcctcaaccacaagcccgtattactaaaactggtagactgactatttctaacgaaacaactacaggttttgatattttaattacgaatattaaagatgataacggtatcgctgctgttaaggtaccggtttggactgaacaaggagggcaagatgatattaaatggtatacagctgtaactactggggatggcaactacaaagtagctgtatcatttgctgaccataagaatgagaagggtctttataatattcatttatactaccaagaagctagtgggacacttgtaggtgtaacaggaactaaagtgacagtagctggaactaattcttctcaagaacctattgaaaatggtttagcaaagactggtgtttataatattatcggaagtactgaagtaaaaaatgaagctaaaatatcaagtcagacccaatttactttagaaaaaggtgacaaaataaattatgatcaagtattgacagcagatggttaccagtggatttcttacaaatcttatagtggtgttcgtcgctatattcctgtgaaaaagctaactacaagtagtgaaaaagcgaaagatgaggcgactaaaccgactagttatcccaacttacctaaaacaggtacctatacatttactaaaactgtagatgtgaaaagtcaacctaaagtatcaagtccagtggaatttaattttcaaaagggtgaaaaaatacattatgatcaagtgttagtagtagatggtcatcagtggatttcatacaagagttattccggtattcgtcgctatattgaaatt

SEQ ID NO: 9964 - protein, 544 aa, Streptococcus agalactiae
MMKKGQVNDTKQSYSLRKYKFGLASVILGSFIMVTSPVFADQTTSVQVNNQTGTSVDANNSSNETSASSVITSNNDSVQASDKVVNSQNTATKDITTPLVETKPMVEKTLPEQGNYVYSKETEVKNTPSKSAPVAFYAKKGDKVFYDQVFNKDNVKWISYKSFCGVRRYAAIESLDPSGGSETKAPTPVTNSGSNNQEKIATQGNYTFSHKVEVKNEAKVASPTQFTLDKGDRIFYDQILTIEGNQWLSYKSFNGVRRFVLLGKASSVEKTEDKEKVSPQPQARITKTGRLTISNETTTGFDILITNIKDDNGIAAVKVPVWTEQGGQDDIKWYTAVTTGDGNYKVAVSFADHKNEKGLYNIHLYYQEASGTLVGVTGTKVTVAGTNSSQEPIENGLAKTGVYNIIGSTEVKNEAKISSQTQFTLEKGDKINYDQVLTADGYQWISYKSYSGVRRYIPVKKLTTSSEKAKDEATKPTSYPNLPKTGTYTFTKTVDVKSQPKVSSPVEFNFQKGEKIHYDQVLVVDGHQWISYKSYSGIRRYIEI

SEQ ID NO: 9965 - DNA, 1242 bp, Streptococcus agalactiae
atgagtaaacgacaaaatttaggaattagtaaaaaaggagcaattatatcagggctctcagtggcactaattgtagtaataggtggctttttatgggtacaatctcaacctaataagagtgcagtaaaaactaactacaaagtttttaatgttagagaaggaagtgtttcgtcctcaactcttttgacaggaaaagctaaggctaatcaagaacagtatgtgtattttgatgctaataaaggtaatcgagcaactgtcacagttaaagtgggtgataaaatcacagctggtcagcagttagttcaatatgatacaacaactgcacaagcagcctacgacactgctaatcgtcaattaaataaagtagcgcgtcagattaataatctaaagacaacaggaagtcttccagctatggaatcaagtgatcaatcttcttcatcatcacaaggacaagggactcaatcgactagtggtgcgacgaatcgtctacagcaaaattatcaaagtcaagctaatgcttcatacaaccaacaacttcaagatttgaatgatgcttatgcagatgcacaggcagaagtaaataaagcacaaaaagcattgaatgatactgttattacaagtgacgtatcagggacagttgttgaagttaatagtgatattgatccagcttcaaaaactagtcaagtacttgtccatgtagcaactgaaggtaaactccaagtacaaggaacgatgagtgagtatgatttggctaatgttaaaaaagaccaggctgttaaaataaaatctaaggtctatcctgacaaggaatgggaaggtaaaatttcatatatctcaaattatccagaagcagaagcaaacaacaatgactctaataacggctctagtgctgtaaattataaatataaagtagatattactagccctctcgatgcattaaaacaaggttttaccgtatcagttgaagtagttaatggagataagcaccttattgtccctacaagttctgtgataaacaaagataataaacactttgtttgggtatacaatgattctaatcgtaaaatttccaaagttgaagtcaaaattggtaaagctgatgctaagacacaagaaattttatcaggtttgaaagcaggacaaatcgtggttactaatccaagtaaaaccttcaaggatgggcaaaaaattgataatattgaatcaatcgatcttaactctaataagaaatcagaggtgaaa

SEQ ID NO: 9966 - protein, 414 aa, Streptococcus agalactiae
MSKRQNLGISKKGAIISGLSVALIVVIGGFLWVQSQPNKSAVKTNYKVFNVREGSVSSSTLLTGKAKANQEQYVYFDANKGNRATVTVKVGDKITAGQQLVQYDTTTAQAAYDTANRQLNKVARQINNLKTTGSLPAMESSDQSSSSSQGQGTQSTSGATNRLQQNYQSQANASYNQQLQDLNDAYADAQAEVNKAQKALNDTVITSDVSGTVVEVNSDIDPASKTSQVLVHVATEGKLQVQGTMSEYDLANVKKDQAVKIKSKVYPDKEWEGKISYISNYPEAEANNNDSNNGSSAVNYKYKVDITSPLDALKQGFTVSVEVVNGDKHLIVPTSSVINKDNKHFVWVYNDSNRKISKVEVKIGKADAKTQEILSGLKAGQIVVTNPSKTFKDGQKIDNIESIDLNSNKKSEVK

SEQ ID NO: 9967 - DNA, 519 bp, Streptococcus agalactiae
atgaaaagaaaagaaattattgatgatgtgaccatgaaacgtgctattacacgtattacctacgaaattatagaacgtaacaaaaatttagataatattgtcttagcaggcattaaaacaagaggtgtttttttagccaaacgcattcaagaacgcttgaagcaattagaaaatttagatattcccgttggagaattggatactaaacctttccgtgatgatatgaaagttgaagttgacaccacaactatgccagttgacatcactgataaagatattatattaattgatgatgttctctatacaggtcgcactattcgagctgctattgataatcttgttagtttagggcgtccgagtcgtgtcagtttagctgtattaattgaccgtgggcatcgtgaactacctattcgtgcagattatgtggggaaaaatattccaacaagtcaatttgaagaaattctagttgaagtgatggaacatgatggttacgatcgtgtgagtattattgatccgagt

SEQ ID NO: 9968 - protein, 173 aa, Streptococcus agalactiae
MKRKEIIDDVTMKRAITRITYEIIERNKNLDNIVLAGIKTRGVFLAKRIQERLKQLENLDIPVGELDTKPFRDDMKVEVDTTTMPVDITDKDIILIDDVLYTGRTIRAAIDNLVSLGRPSRVSLAVLIDRGHRELPIRADYVGKNIPTSQFEEILVEVMEHDGYDRVSIIDPS

SEQ ID NO: 9969 - DNA, 888 bp, Streptococcus agalactiae
atggaaatcacaattaaaatagcaggagttaggctagataaagctttagcggataattctgaactgtcgcgtagtcaagctaatgaagaaattaaaaaagggattgtgttagtaaatggacaagtaaaaaaagcgaaatatactgttcaagaaggagatcggattacttttgatattcctaaagaggaagtactagattatcaagctgaaaatatccctttagatattatctatcaagatgatgacgttgctgtggttaataagccgcaagggatggttgttcacccttctgcaggccacagttcgggcaccttagttaacgccttgatgtatcatattaaggatttatcatcaattaatggcgttgttcgcccagggatcgttcatcgtattgataaagatacttctggtttattgatggttgcaaaaaatgatagagctcaccaagtgttggctgaagagttaaaagataaaaaatcgcttcgtaaatatttagcaattgtgcatggtaatttaccaaatgatcgaggtgtgattgaggctccgattggtagaagcgataaagatcgtaagaagcaagccgtgactgctaaaggtaagccagcaataactcgttttcatgttttagaacgttttggtgattataccttagttgaattgtcattggagacaggtcgaacacaccaaattcgggttcatatggcttatattggccatcctctagccggtgatcctgtctacggtccccgtaagactttagggggtaaaggacagtttttgcatgcacaaacactaggttttacgcaccctagtaacggagagaatttgattttttcagtagaggttccggaaatttttcagacaaccttagaaaagttgagaaaaaat

SEQ ID NO: 9970 - protein, 296 aa, Streptococcus agalactiae
MEITIKIAGVRLDKALADNSELSRSQANEEIKKGIVLVNGQVKKAKYTVQEGDRITFDIPKEEVLDYQAENIPLDIIYQDDDVAVVNKPQGMVVHPSAGHSSGTLVNALMYHIKDLSSINGVVRPGIVHRIDKDTSGLLMVAKNDRAHQVLAEELKDKKSLRKYLAIVHGNLPNDRGVIEAPIGRSDKDRKKQAVTAKGKPAITRFHVLERFGDYTLVELSLETGRTHQIRVHMAYIGHPLAGDPVYGPRKTLGGKGQFLHAQTLGFTHPSNGENLIFSVEVPEIFQTTLEKLRKN

SEQ ID NO: 9971 - DNA, 1152 bp, Streptococcus agalactiae
atgcgcttcatcaataagttaaaaaataatatggagcatgtactctccatttatccagatgtttcagtaaaaacagatcgtgatagaggacatgtatatctcaatggtacagattatcatgaagttgcagagtccttaaaagagatttttggtatccaagctttttctccatcttttaaagtagaaaaaaatgttgatacattggtaaaagctgtccaggaaattatgacttccgtttataaagatgggatgacttttaaaattaccgcaaaacgtagtgaccactcatttgaattggatagccgtgctctaaatcatactttaggagatgctgttttttcagtcttgccaaatattaaggctcagatgaagcaaccagatatcaatcttaaagtcgagatacgagatgaggctgcttatatttcatatgaggatattaggggtgcaggaggattaccagtaggaacatctggaaaagggatgctgatgttgtctggtgggattgattctccggtagcaggttacctagcgttaaaacgtggtgtagatatagaagcagtccattttgcaagtcctccttatactagcccaggtgcattgaaaaaagcacatgatttaacacgtaaattgacaaaatttggtggtaatattcaatttattgaagttccattcacagaaattcaagaggaaattaaggcaaaagctcccgaagcctacttgatgacgttaacacgtaggtttatgatgcgtattacagatcgtattcgtgaggaccgaaatggtcttgttattattaacggtgaaagtttaggacaggtggcaagccaaacgttagaaagtatgcaagctattaatgctgtcactgcaacaccgattattcgtcctgtggtcacgatggataagctagaaattattgatattgctcaaaaaatagatacttttgatatttcaattcaaccatttgaggattgctgtacgatttttgcaccagatcgcccaaaaactaaccctaaaattaagaatacagaacagtatgagaaacgtatggatgtagaaggtcttgtagagagggcagttgcagggattatggtaactactattcaacctcaagcagatagtgatgatgttgatgacttgattgacgatttatta

SEQ ID NO: 9972 - protein, 384 aa, Streptococcus agalactiae
MRFINKLKNNMEHVLSIYPDVSVKTDRDRGHVYLNGTDYHEVAESLKEIFGIQAFSPSFKVEKNVDTLVKAVQEIMTSVYKDGMTFKITAKRSDHSFELDSRALNHTLGDAVFSVLPNIKAQMKQPDINLKVEIRDEAAYISYEDIRGAGGLPVGTSGKGMLMLSGGIDSPVAGYLALKRGVDIEAVHFASPPYTSPGALKKAHDLTRKLTKFGGNIQFIEVPFTEIQEEIKAKAPEAYLMTLTRRFMMRITDRIREDRNGLVIINGESLGQVASQTLESMQAINAVTATPIIRPVVTMDKLEIIDIAQKIDTFDISIQPFEDCCTIFAPDRPKTNPKIKNTEQYEKRMDVEGLVERAVAGIMVTTIQPQADSDDVDDLIDDLL

SEQ ID NO: 9973 - DNA, 654 bp, Streptococcus agalactiae
atgcctcgcagtcttgaagaggctcaagaaatagatttatcaaaatttgatagtgttgatattattgaatggcgagctgatgccttaccaaaggatgacattattaatgtagctccagctatttttgagaaattcgcaggtcatgaaattatttttactcttcgtacaacgcgtgaaggtggtaatattgtcttatctgatgctgagtatgttgagttaatccagaaaattaattctatctacaatccagattatattgattttgagtatttttcacataaagaagtttttcaagaaatgctagaatttccaaatttagtcctgtcttatcacaattttcaagagacaccggagaatattatggagatattttcagaattaacagccctagcaccacgagttgtgaaaatcgcagtaatgccaaagaatgaacaagatgtcttagacgttatgaattacactcgcggtttcaagactattaatcctgatcaagtttatgcgacggtatctatgagtaaaattggacgtatttctcgttttgctggtgatgtaactggatctagttggacatttgcatatttagattcatctatcgcacccggacaaattactatttcagagatgaagcgtgtcaaagcattgcttgacgctgac

SEQ ID NO: 9974 - protein, 218 aa, Streptococcus agalactiae
MPRSLEEAQEIDLSKFDSVDIIEWRADALPKDDIINVAPAIFEKFAGHEIIFTLRTTREGGNIVLSDAEYVELIQKINSIYNPDYIDFEYFSHKEVFQEMLEFPNLVLSYHNFQETPENIMEIFSELTALAPRVVKIAVMPKNEQDVLDVMNYTRGFKTINPDQVYATVSMSKIGRISRFAGDVTGSSWTFAYLDSSIAPGQITISEMKRVKALLDAD

SEQ ID NO: 9975 - DNA, 792 bp, Streptococcus agalactiae
atgtctcacataaaagcagaaaacattatcgtatcttacgatcagaaagaaatcatcaataatctttccctcagtatacttaaccaaaaaataacaacgattattggtgccaatggatgtggaaagtctactcttttgaaggctctcacacgcatccataaaataaaagatggtactatcactattgatggtcatgatattgcacatttacccacaaaggaaattgctaagaagattgcacttctcccacaggtgttagaagcaactgaagggataacagtttatgaactaatatcttatggacggttcccacaccaaaaataccttggcaatttgacaaatgacgatcgcagtaaaatccattgggcgatggaaatgactaacgtagcgcaatttgctaatagagatgttgatgacctttcaggaggtcagaggcaaaaagtatggattgctatggctttagcacaagatacagatactatctttttagacgaacctacaacttatcttgacatgaatcatcaattagaagtcttagaattgctcaaaaaacttaatgacgaaacgcaaaaaacaattattatggtcctacacgacctaaacctgtctgcgcgctattctgattatctagttgcaatgaaaaccggtaaaattatctatgaaggtagtcctagtcagatcatgactaaagatattatcaaagatatttttaagattgatgctcatatcattcaggaccctattagtaaacaacctgttttgttatcttatcaattatcaactgatcaaaat

SEQ ID NO: 9976 - protein, 264 aa, Streptococcus agalactiae
MSHIKAENIIVSYDQKEIINNLSLSILNQKITTIIGANGCGKSTLLKALTRIHKIKDGTITIDGHDIAHLPTKEIAKKIALLPQVLEATEGITVYELISYGRFPHQKYLGNLTNDDRSKIHWAMEMTNVAQFANRDVDDLSGGQRQKVWIAMALAQDTDTIFLDEPTTYLDMNHQLEVLELLKKLNDETQKTIIMVLHDLNLSARYSDYLVAMKTGKIIYEGSPSQIMTKDIIKDIFKIDAHIIQDPISKQPVLLSYQLSTDQN

SEQ ID NO: 9977 - DNA, 582 bp, Streptococcus agalactiae
atgacaaatacacgtaaaatggtgacaatcgccattctttctgccttatcttttgtattgatgatggtttcatttccattaataccaggagcagaatttttaaaggttgatttttcaatccttccgatgttagttgcttttattttatttgatttgaaatcaagttatggtgtactcttattaagatcacttttaaaagttatacttgctaatcgtggtccagaaacgtttattggtttaccgatgaatatggttgctctagctttatttttagcaagtttcgctattttctggaaaaatagagagagtgcaaaagattttattaaagctagtctatttggtacagttagcttgaccgtatctatggtagctctcaactatgtctttgcgattcctttgtatgctatatttgctaactttgatatcagaacatttattggtgtaggcaattaccttttaacaatggttattccatttaatatcgttgagggaattttaatttcgattgttttctatctaacttacgtggcttgtttgccaatattagaaagatataaaaagactaatgttatctcgtcaaaa

SEQ ID NO: 9978 - protein, 194 aa, Streptococcus agalactiae
MTNTRKMVTIAILSALSFVLMMVSFPLIPGAEFLKVDFSILPMLVAFILFDLKSSYGVLLLRSLLKVILANRGPETFIGLPMNMVALALFLASFAIFWKNRESAKDFIKASLFGTVSLTVSMVALNYVFAIPLYAIFANFDIRTFIGVGNYLLTMVIPFNIVEGILISIVFYLTYVACLPILERYKKTNVISSK

SEQ ID NO: 9979 - DNA, 978 bp, Streptococcus agalactiae
ttgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattt

SEQ ID NO: 9980 - protein, 326 aa, Streptococcus agalactiae
MIENYLEKDILNQIKLLTLCYDYYPSITLDKSCHQLGLSELLIRKYCHDLTTLFNSQLSLNIEKSTIVYQSNGVTREQAFKYIYHQSHVLQLLKFLITNDSGRLPLTYFSEKFGLSCATAYRIRKHISPLLEKLGFQIVKNTITGDEYRIRYLIAFLNAQFGIEVYPMSKMDKLLIKRLLLEHSTTFTASHYFPNTFIFFDTLLSLSWKRINYNVVVPYSSLFTELQNIFIYDTLQYCVKNVIIDSFKINLKKDDIDYIFLAYLTSHNSFSNPNWTEKRIDNVIAIFENYPKFQKLLQPLKDALPLSGSYHDELVKVAIFFSEHLF

SEQ ID NO: 9981 - DNA, 924 bp, Streptococcus agalactiae
atggcaacatataatggtcaaggtttcatccacgatcagctagattcaattagaaatcaaacgttgagaccagactatgtcttaatgagggacgatggctctactgatgatactgtaaaggtggttgaagactatataaaagagcaccgtttagatggttggtcaataactagtaatgataaaaatttaggttggcgtttaaattttcgtcaattacttattgatgtgttagcctatgaggttgactatgtcttttttagtgatcaagatgacacatggtatcatcataaaaataagatgcaagttgatattatggaagaacgccaagatataaaccttcttagcgccgatattgatatcaaaaagttatcagaagaggctactattcccaataattttaagttcaatggtgaggaaacaatttctaagtatccattagacttttcatatcataactatcgtcaaggttggactttttgtttacgcaagtcgtttgttgatcaagtaatgactttttacagtgataatttaattttgtcacatgataatctttttgcaggggtatctggtgtcattggttcaggttacaatttaaacagaagtgttggtgaacataagcgacatgctgagaatgcaagtgggaatatcttgaatatgagctcaagttacgaaaggcatttacaagaactgtattttgttttgagttactatatcatccttgtaccatttttagaaaaaagtagctctagtcaattaagggaagctaaagcttatctggattttaatcagcaacgttataaaaatgctcaaaataaagattttgtagcaatacttaaacaaatgatgactaaaaaacggttctatgatagcttttcaaatcgcattcgtgacttggtgtttttattaaaagatataaaaaggagt

SEQ ID NO: 9982 - protein, 308 aa, Streptococcus agalactiae
MATYNGQGFIHDQLDSIRNQTLRPDYVLMRDDGSTDDTVKVVEDYIKEHRLDGWSITSNDKNLGWRLNFRQLLIDVLAYEVDYVFFSDQDDTWYHHKNKMQVDIMEERQDINLLSADIDIKKLSEEATIPNNFKFNGEETISKYPLDFSYHNYRQGWTFCLRKSFVDQVMTFYSDNLILSHDNLFAGVSGVIGSGYNLNRSVGEHKRHAENASGNILNMSSSYERHLQELYFVLSYYIILVPFLEKSSSSQLREAKAYLDFNQQRYKNAQNKDFVAILKQMMTKKRFYDSFSNRIRDLVFLLKDIKRS

SEQ ID NO: 9983 - DNA, 933 bp, Streptococcus agalactiae
atggtaaagacagcagttttaatggcgacatacaatggcgaaatatttatatctgaacaacttgattcaattcgccaacagacattaaaaccagattatgtattattgagggatgattgttcaacggatgaaacagtcaatgtcgtcaataactatatcgcaaaacatgagttagaaggctggaaaattgttaaaaacgacaaaaacttaggctggcgtttaaattttcgtcaattacttattgatgtgttagcctatgaggttgactatgtcttttttagtgatcaagatgatatttggtatcttgataaaaacgaacgacagtttgccattatgtcagataaacctcaaattgaggttttgagtgcagacgttgatatcaaaacgatgtctacagaagccagtgttccacattttctaactttttcttctagtgatagaatcagtcagtatcctaaagtatatgattatcaaacattccgtcccggatggaccattgctatgaagagagattttgcgcaagctatcgctgataattggacttttggagctaatatttcgcacgataatcttatcgagacaactgccagtattattggaaatggttataaccttaacgaaagcgtaggagttcatattcgatatggaggaaacgcaagtggtaatagcaaatttgttttgaattggaagtcgcctaaaacacaacatatcacaggattaaaaacatttgttgatttttacgaaaccatgcagaaggttgtcaacaaatatcaaaatgatgtcgctttaaatcaacgcttagcctttgaaaaagaaagattggaagcttctaaattgtcattaattcataatagtgcttttgtgattaaaaattggcgactctataactctaatagtggacgtatgagagatttattatttgcgtttaaaaag

SEQ ID NO: 9984 - protein, 311 aa, Streptococcus agalactiae
MVKTAVLMATYNGEIFISEQLDSIRQQTLKPDYVLLRDDCSTDETVNVVNNYIAKHELEGWKIVKNDKNLGWRLNFRQLLIDVLAYEVDYVFFSDQDDIWYLDKNERQFAIMSDKPQIEVLSADVDIKTMSTEASVPHFLTFSSSDRISQYPKVYDYQTFRPGWTIAMKRDFAQAIADNWTFGANISHDNLIETTASIIGNGYNLNESVGVHIRYGGNASGNSKFVLNWKSPKTQHITGLKTFVDFYETMQKVVNKYQNDVALNQRLAFEKERLEASKLSLIHNSAFVIKNWRLYNSNSGRMRDLLFAFKK

SEQ ID NO: 9985 - DNA, 1053 bp, Streptococcus agalactiae
atgattaaatttagtaataaaattgtacaagaagatttagcacttattagtaaccaaaattatattaattgggaaagaattgctaataaaggcgttttaataagtggttctaatagtatgttagcgagttatatggtatttttactagcctatctcaatgagacaagaaattaccaaacgcaaattattgcgacagctagaaacattgaaaaagcccgtgataaattttcagatttagttgggaaagattatttcaccttaattccttatgatgtagaagaacgcctagagtatgatggaaaagtggattacattatccatgcagcaagcaatgctagtccaactgctattttgagtaatcctgttagcatcataaaagctaatacaattggtacattgaatttattagactttgcaaaggaaaaaacaattgaaaacttcttgttcttatcaacgcgtgaagtatatggaacatctattaaagaagtgattgatgaagaagcttatggtggatttgatattttagctactagagcttgttacccagaaagcaaacgtatggctgaaactctactgcaaagttactatgatcaatataaggtaccctttactattgctcgtattgcacattcatttggtcctggtatggagcttggtaacgatggtcgtattatgaatgatcttttatcgaatgtcattgatggcaaagatatcgttttaaaaagtagtggtacagcagagcgtgctttctgttatttagcagatgctgtatcagggttatttactattttattaaatggtgaagttggtcaagcttacaatgtagcaaatgaagatcaacccattatgattaaggatttggcacaaaagttagttgatctcttttctgataaaaatatttcagtagtattcgatattcctaaaactatgagtgcaggttatagcaaaatggggagaacacgtctcactatggccaaattagaagcgttgggatggaagcgagaagtttctcttgaatctggaatattaaaaacagtacaagcatttgaggag

SEQ ID NO: 9986 - protein, 351 aa, Streptococcus agalactiae
MIKFSNKIVQEDLALISNQNYINWERIANKGVLISGSNSMLASYMVFLLAYLNETRNYQTQIIATARNIEKARDKFSDLVGKDYFTLIPYDVEERLEYDGKVDYIIHAASNASPTAILSNPVSIIKANTIGTLNLLDFAKEKTIENFLFLSTREVYGTSIKEVIDEEAYGGFDILATRACYPESKRMAETLLQSYYDQYKVPFTIARIAHSFGPGMELGNDGRIMNDLLSNVIDGKDIVLKSSGTAERAFCYLADAVSGLFTILLNGEVGQAYNVANEDQPIMIKDLAQKLVDLFSDKNISVVFDIPKTMSAGYSKMGRTRLTMAKLEALGWKREVSLESGILKTVQAFEE

SEQ ID NO: 9987 - DNA, 717 bp, Streptococcus agalactiae
atgaatattggagttatttttgcaggtggtgttggtcgtcgcatgaataccaaaggtaaaccaaagcaattcctagaagtgcatggtaaacccattattgtacacacaattgatattttccaaaatacagaagctattgatgctgtagtagttgtctgtgtatcagactggctagattatatgaataatctggtagagcgtttcaaccttacgaaagtaaaagcagttgttgcaggtggagaaactggccaaatgtcaatttttaaggggcttgaagccgctgaacagctggctacagatgatgccgttgttttaattcatgacggagtacgtccattgattaatgaagaagttattaatgctaatatacagtcagtaaaagaaacaggaagtgcggtaacttcagttcgtgctaaagagacagttgttctagtcaatgattcttctaaaatatctgaagttgttgatcgtactcgttccttcattgctaaagcgccacaaagtttttatctatcagatatcctttctgttgaacgtgatgccattagcaaagggattactgatgcaattgattctagtactttgatgggtatgtacaatcgtgaactcactattgttgagggaccatatgaaaatatcaagataacaacaccagatgatttttatatgtttaaagctttgtatgatgctagagaaaatgaacaaatttatgggatg

SEQ ID NO: 9988 - protein, 239 aa, Streptococcus agalactiae
MNIGVIFAGGVGRRMNTKGKPKQFLEVHGKPIIVHTIDIFQNTEAIDAVVVVCVSDWLDYMNNLVERFNLTKVKAVVAGGETGQMSIFKGLEAAEQLATDDAVVLIHDGVRPLINEEVINANIQSVKETGSAVTSVRAKETVVLVNDSSKISEVVDRTRSFIAKAPQSFYLSDILSVERDAISKGITDAIDSSTLMGMYNRELTIVEGPYENIKITTPDDFYMFKALYDARENEQIYGM

SEQ ID NO: 9989 - DNA, 777 bp, Streptococcus agalactiae
atgttagcttatattgataaagttgcgcgtgataataaaattgaatattctttaggcggaggcagcctactgggagcaatgagacataaaggattcattccatgggatgacgatattgatttgatgctagaaagaagccagtatgagcgtttgatgaaagcattagctgatgctaataatagcgattttaaattgctacatcattctgttgaaaaaaatctatggccatttgccaagctgtatcacacaaagtcaatgtacttaagtaaaacagatagaattcatccttggacagggatttttattgatatcttcccacttgaccgattaccagagagtgcagaagaacgtcaaagattctttaaaaaagttcactctgctgctgcaaatttgatgtgtacgacttaccccaattttgctagcggttcccgaaagctttatgcaaatgcaaggctaattttggggctaccccgattcatcgcttatcacggccaagctaaaaaacgtgctgaaattgttgatcaagtgatggaaacatataataatcaagaggttccttacatgggttataccgattcaagatatcgcttgaaagaatattttccaagagaaattttttctgagtatgaagatgttatgtttgaaaacattaaaacccgaaaaattaaaaatgagcatgcttatctgaatcaattatatgggggtagttatatggaattacctccagaaagtaagagagaaagtcatagttattacacttggtactggaaagaaggt

SEQ ID NO: 9990 - protein, 259 aa, Streptococcus agalactiae
MLAYIDKVARDNKIEYSLGGGSLLGAMRHKGFIPWDDDIDLMLERSQYERLMKALADANNSDFKLLHHSVEKNLWPFAKLYHTKSMYLSKTDRIHPWTGIFIDIFPLDRLPESAEERQRFFKKVHSAAANLMCTTYPNFASGSRKLYANARLILGLPRFIAYHGQAKKRAEIVDQVMETYNNQEVPYMGYTDSRYRLKEYFPREIFSEYEDVMFENIKTRKIKNEHAYLNQLYGGSYMELPPESKRESHSYYTWYWKEG

SEQ ID NO: 9991 - DNA, 726 bp, Streptococcus agalactiae
atgaaaaaaattttactagtgatacctgcttataatgaagaaggtagtattgcaaagacagtccagactattgtagattttaaggcgtctcgctcactaccttttgagctggattatattgttattaacgatgggtcaaccgatggtactccagagttattagatagattgggtttaaatcatattgaccttgttcaaaatctaggtattggtggctgtgtgcagacaggatacttatacgctaatcgtaatcattacgatgttgccgttcaatttgatggtgatggtcaacatgatattagaagcattgaagatgttgttatgccaatcttaaatgacgaagcagattttgttattggttctcgctttgttgataaaaaacatcaaaattttcaatcgacagcaatgaggcgtcttggcataaatttaatatctgctgctataaaattaacgacgggacacaaagtctatgatacaacaagtggttatagggcagccaacgcggcgctaatagcttatttatcgtgtcattatccagtacaatacccagagcctgaatcaactgctcggattttgaaaaaaggctatcgtttgaaggaagtcacagctaatatgtttgaacgtgaggcaggtacttcaagtataagttccctaaaatcgattttttatatgacggatgttttaacatcaattattattgcagggtttattaaggaggatgataaa

SEQ ID NO: 9992 - protein, 242 aa, Streptococcus agalactiae
MKKILLVIPAYNEEGSIAKTVQTIVDFKASRSLPFELDYIVINDGSTDGTPELLDRLGLNHIDLVQNLGIGGCVQTGYLYANRNHYDVAVQFDGDGQHDIRSIEDVVMPILNDEADFVIGSRFVDKKHQNFQSTAMRRLGINLISAAIKLTTGHKVYDTTSGYRAANAALIAYLSCHYPVQYPEPESTARILKKGYRLKEVTANMFEREAGTSSISSLKSIFYMTDVLTSIIIAGFIKEDDK

SEQ ID NO: 9993 - DNA, 1152 bp, Streptococcus agalactiae
atgcaagatgttttcattataggaagtagagggttgccagctcgttacggtggttttgaaacttttgtttcagaattgattaatcatcaaaaaagtttcgacataaaataccatgttgcatgccttagtgataaagaacatcatactcattttaactttgctgacgctgattgttttactataaatcctccccaattagggccagcacgtgtgattgcttatgatattatggccattaattatgcccttgacttggttaagacacatgatttaaaagagcctattttttatattttaggaaatacaattggtgcctttatttggcattttgccaataaaatacataaagtcggtggcttattgtatgttaatccggatggtttagagtggaagcgatcaaagtggtctcgtcccacacagcgttatttaaaatacgccgaaaaatgtatgactaaaaatgcagacctaattatttctgataatattggtattgaaaattacattcaatctacctactctaatgtgaagacaaggttcattgcttacggtacagagattaattctaggaaattatcgtcagatgatccacgtgtcaaacagttgtttaaaaaatggaatattaagtctaagggttactatctaatcgttggtcgatttgtccctgaaaacaattatgaaacggctattagggagttcatggcttcagatactaagcgtgatttagttattatctgtaaccatcaaaataacccctactttgaaaagttgtccttaaagacaaaccttcaacaagataaaagagttaagtttgtaggtacgctctatgaaaaagatctgctggattatgttcgtcaacaagcctttgcttatattcatgggcatgaagttggcggtactaatccaggactgcttgaggctttagctaatactgatttgaatcttgttctagatgttgatttcaacaaatcagtagcaggtctctcaagtttttactgggctaaaaaagagggggatttagctaagcttattaacgatagtgatcaacaacaggatttatctacttacggtgatcgagcaaaagccattattcaagaaaactatacttggaaaaaaattgttgaagaatatgaggatttgtttttaaatgaaagt

SEQ ID NO: 9994 - protein, 384 aa, Streptococcus agalactiae
MQDVFIIGSRGLPARYGGFETFVSELINHQKSFDIKYHVACLSDKEHHTHFNFADADCFTINPPQLGPARVIAYDIMAINYALDLVKTHDLKEPIFYILGNTIGAFIWHFANKIHKVGGLLYVNPDGLEWKRSKWSRPTQRYLKYAEKCMTKNADLIISDNIGIENYIQSTYSNVKTRFIAYGTEINSRKLSSDDPRVKQLFKKWNIKSKGYYLIVGRFVPENNYETAIREFMASDTKRDLVIICNHQNNPYFEKLSLKTNLQQDKRVKFVGTLYEKDLLDYVRQQAFAYIHGHEVGGTNPGLLEALANTDLNLVLDVDFNKSVAGLSSFYWAKKEGDLAKLINDSDQQQDLSTYGDRAKAIIQENYTWKKIVEEYEDLFLNES

SEQ ID NO: 9995 - DNA, 375 bp, Streptococcus agalactiae
atgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgctgaagaagaaattattgaagttgttgaaccaacacaagagcaattacttgctgaaatccgcgacttactcgctaacaaa

SEQ ID NO: 9996 - protein, 125 aa, Streptococcus agalactiae
MIKELKEFLFKGNVLDLAVAVILGAAFNAIITSLVKDVITPLILNPVLKAAGVSNIAQLSWNGVAYGNFLSAVINFLIVGTTLFFIVKAANKVMAKKPAEEEIIEVVEPTQEQLLAEIRDLLANK

SEQ ID NO: 9997 - DNA, 1017 bp, Streptococcus agalactiae
gtgtttttactattatgtattttatcgatgtggctcatgatttttggggttgcattctattactttgggtcgctacatcaatcattgacttcaaggattatttatcagtttgtacttactgttttgctaacgacaacagcttggttcatgggtgcctattttttagcatttgaaggtcattttaaaactgtctttcaattccaagaagcagatggtaaacaaattgtaaattgtttatttcaactttgtttcgccctttacgcagtagtaatgcttattgggtcaattattgatagagttcagacgaagcgacttttattagctgttgtttcttggcttttcttggtgtatacgcccttagcttatttaatttggaattcagagggtgtttttgcaaagatgggagtacttgatttttcaggcggaatgatcgttcatttatctgcagggctttcttcgtatattttagctcatgttattggcaagagtgaacatcagcacaataaggttaaaaatgatagtctctttttaggaatgatacttattacatttggttggtttggatttaatatgggtccagttggtgagtggaattcacaagccattatgatacttttaaatactatatttgctattataggtggtggtttggcgtggacattggctgctaagtggaatggtgaggaagagaaaacaggaagcttattgaatggcattattgttggtcttgtgacgagtacagcaggagttgggtatctcttaacttggcaattattagctgtaacattctttgcatccctcttcacctactttgtaacggattacgttgcgaaagcttttgccattgatgatgtcgtttcctcctttggaatgaatggtattgggggattgttgggaagtttaggagttggtctctttaaattatcacatatgccagttcaactgttagcattagctaccacaattcttttgtcaattataatgacctatatcatatctaaagcgatttttagaaaa

SEQ ID NO: 9998 - protein, 339 aa, Streptococcus agalactiae
MFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 9999 - DNA, 1245 bp, Streptococcus agalactiae
atggaaaaaaatacttggaaaaaattacttgttagtactgctgctctttcagtagttgcaggaggagcaattgctgctactcactctaactcagttgatgctgcttcaaaaacaactatcaaactttgggtcccaacagattcaaaagcgtcttataaagcaattgttaaaaaattcgagaaggaaaacaaaggcgttactgtaaaaatgattgagtctaatgactccaaagctcaagaaaacgtaaaaaaagacccaagcaaggcagccgatgtattctcacttccacatgaccaacttggtcaattagtagaatctggtgttatccaagaaattccagagcaatactcaaaagaaattgctaaaaacgacactaaacaatcacttactggtgcacaatataaagggaaaacttatgcattcccatttggtattgaatctcaagttctttattataataaaacaaagttaactgctgacgacgttaaatcatacgaaacaattacaagcaaagggaaattcggtcaacagcttaaagcagctaactcatatgtaacaggtcctcttttcctttctgtaggcgacactttatttggtaaatctggtgaagatgctaaaggcactaactggggtaatgaagcaggtgtttctgtccttaaatggattgcagatcaaaagaaaaatgatggttttgtcaacttgacagctgaaaatacaatgtctaaatttggcgatggttctgttcatgcttttgaaagtggaccatgggattacgacgctgctaaaaaagctgtcggtgaagataaaatcggtgttgctgtttacccaacaatgaaaatcggtgacaaagaagttcaacaaaaagcattcttgggcgttaaactttatgccgttaaccaagcacctgctggttcaaacactaaacgaatctcagctagctacaaactcgctgcatatctaactaatgctgaaagtcaaaaaattcaattcgaaaaacgtcatatcgttcctgctaactcatcaattcaatcttctgatagcgtccaaaaagatgaacttgcaaaagcagttatcgaaatgggtagctcagataaatatacaacggttatgcctaagttgagtcaaatgtcaaccttctggacagaaagtgctgctattcttagcgatacttacagtggtaaaatcaaatctagcgattaccttaaacgtctaaaacaattcgataaagacatcgctaaaacaaaa

SEQ ID NO: 10000 - protein, 415 aa, Streptococcus agalactiae
MEKNTWKKLLVSTAALSVVAGGAIAATHSNSVDAASKTTIKLWVPTDSKASYKAIVKKFEKENKGVTVKMIESNDSKAQENVKKDPSKAADVFSLPHDQLGQLVESGVIQEIPEQYSKEIAKNDTKQSLTGAQYKGKTYAFPFGIESQVLYYNKTKLTADDVKSYETITSKGKFGQQLKAANSYVTGPLFLSVGDTLFGKSGEDAKGTNWGNEAGVSVLKWIADQKKNDGFVNLTAENTMSKFGDGSVHAFESGPWDYDAAKKAVGEDKIGVAVYPTMKIGDKEVQQKAFLGVKLYAVNQAPAGSNTKRISASYKLAAYLTNAESQKIQFEKRHIVPANSSIQSSDSVQKDELAKAVIEMGSSDKYTTVMPKLSQMSTFWTESAAILSDTYSGKIKSSDYLKRLKQFDKDIAKTK

SEQ ID NO: 10001 - DNA, 1482 bp, Streptococcus agalactiae
atggaatggctctttattaaaccagatcaaatttctgactttgtaactacagaaaataattatcttacatcgtcaaagttattgcaaaaactacctcgaaaaatatctgctcttttgttgacagagcaaacttatggaccagagttatctagtttatcgtcattctttgaggtttatgaagtattttatcctaaagataaacatgctacggggataacagaagagtttttacgctcgaaaatggcccaacgatatgatagtagctctccagatcagctaattcgtcaattttataaagggctttttataggacaatacggagagaaacttcaagtttcacaaatacaaattagaaatgattttgaaggtgtagtaaactatcagggaaataactatcttgaattagaagggcaatttggtgagaactatagttttttgcttaattttgcttacaatattccattttcatcggatttttataatgagttatttttagaacacattatagagggtgatatagatattcgattggttatctcgttgattgttgatggttctgttgatgatattgctaaagagtggtactttgagaaggaagacctaaatcaacttatttctttagagtccgatattagtggtagccttgcagttaaactttttgctaagggaaagggtatcgttaagttaggtccattgcaccgtcgtaatggtagaggaggattgggcacatttctactaggaggagaacgtcacatagatgctataggtcatgaatttatgacttattttgatccagtagatttcaaaccacctctaactgtttatttttcgggatttcgttcagctgaaggctttgagggattctggatgatgaagagtatgaagactccattcatgttaatttgtgatccacgattacaaggtggtgccttttatataggaagcaaagaatatgaacaaaaaatagttgatgctattcaagaaaaactggcctttttaaattttagttctgatcagttaattttatccggactttcaatggggacttatggtgctacttaccatggtgctaagctaaatcctcatgctattattattggtaaaccaatatttaatttaggaacagttgctcaacgtgaaagattagagagaccagatggatttgctacttcattagatattcaactactcaatcaaggtgacttgaccagttcctcttctgagaagttaaataactatttttggaaatctatagaagaaggagatttttcaaatacgacttttgccttagcctatatgaaaaacgatgactatgatgcgactgccttttctgatttattgcaatattttagaggaaagaagcataagatattaggcagaggttgggatggccgacatggtgattgttctgcagaagttggtgcatggtttacaagtcagtataggcgaatgctatctaatgattttggaaggaaagaagaa

SEQ ID NO: 10002 - protein, 494 aa, Streptococcus agalactiae
MEWLFIKPDQISDFVTTENNYLTSSKLLQKLPRKISALLLTEQTYGPELSSLSSFFEVYEVFYPKDKHATGITEEFLRSKMAQRYDSSSPDQLIRQFYKGLFIGQYGEKLQVSQIQIRNDFEGVVNYQGNNYLELEGQFGENYSFLLNFAYNIPFSSDFYNELFLEHIIEGDIDIRLVISLIVDGSVDDIAKEWYFEKEDLNQLISLESDISGSLAVKLFAKGKGIVKLGPLHRRNGRGGLGTFLLGGERHIDAIGHEFMTYFDPVDFKPPLTVYFSGFRSAEGFEGFWMMKSMKTPFMLICDPRLQGGAFYIGSKEYEQKIVDAIQEKLAFLNFSSDQLILSGLSMGTYGATYHGAKLNPHAIIIGKPIFNLGTVAQRERLERPDGFATSLDIQLLNQGDLTSSSSEKLNNYFWKSIEEGDFSNTTFALAYMKNDDYDATAFSDLLQYFRGKKHKILGRGWDGRHGDCSAEVGAWFTSQYRRMLSNDFGRKEE

SEQ ID NO: 10003 - DNA, 1005 bp, Streptococcus agalactiae
atgcgagtacatattacaagtatatatgggcagtcaccgcgtagcattgcccttatatcacaaaaactagttaaggatgtcggacgtcaacttggttatgatgaaatgggaatctacttttataatgatcatgctgaaacgcatggtgaaagaagtactaggatggatggtatcattgcgggattaggcagaggggatattgttgtttttcaagtacctacatggaattcaacagaatttgatgaactttttctagataaattacaggcatacggtgctagaattataacttttgtacatgatattgttcccttaatgtttgagtctaatttttatttattagatagagtaattgacatgtataatcgttcggatgttgttattctacctacaaaagcgatgcatgattatctaattgaaaaagggatgactacctctaaagttctttatcaagaagtatgggatcatccagttaatatagacctccctcgtccagaatgtcaaaaagtccttagttttgcaggcgatattcaacgctttccctttgtcaatgactggaaggaaaatatcccgctcatctattatggagacggaagcagactcaattctgaggcaaatgttcatgctcagggatggaaagatgatgtagaattgatgctaagtctttctaagcggggaggatttggcctgtgttggagtgaagatagagaggagttagtcgagcgtcgttattcgaggatgaatgcctcgtataaattatctactttcttggctgctggacttccaattattgctaaccatgatatttcaagtagagactttatcaaacaacacggattaggatttacagttgaaacgctagaagaagctgttgaaaaaattaataatatggaaaaagagacttatgacagctatgtggaaaatgttgagaagatagcaactctcttgcgaaatggttatatcactaaaaaattgttgatagatgctgtgcatatgctttataga

SEQ ID NO: 10004 - protein, 335 aa, Streptococcus agalactiae
MRVHITSIYGQSPRSIALISQKLVKDVGRQLGYDEMGIYFYNDHAETHGERSTRMDGIIAGLGRGDIVVFQVPTWNSTEFDELFLDKLQAYGARIITFVHDIVPLMFESNFYLLDRVIDMYNRSDVVILPTKAMHDYLIEKGMTTSKVLYQEVWDHPVNIDLPRPECQKVLSFAGDIQRFPFVNDWKENIPLIYYGDGSRLNSEANVHAQGWKDDVELMLSLSKRGGFGLCWSEDREELVERRYSRMNASYKLSTFLAAGLPIIANHDISSRDFIKQHGLGFTVETLEEAVEKINNMEKETYDSYVENVEKIATLLRNGYITKKLLIDAVHMLYR

SEQ ID NO: 10005 - DNA, 618 bp, Streptococcus agalactiae
atgatagaaaattttttagaaaaaaatattcttaataaagttaaattacttactttatgttatgataccccctcactatccttagataccgcctgtaaccgactccacttatcaccagttgagcttaaaaactattgtcataaattaaatgttttatttggtcataaactttctatccatatccaaaaaaaacggattttatgtaagctaaataaacttactcaggaagatgccttaaaaatagtttataatgagtcaaacactttacaacttcttaaatttttaattgatgactcgtctgataaaaaatctctagtagcttttggaaatgatctcttcttatctcgttcttctgtctatcgtctgcgagaaaatttaattcctttaattaaagatttaggattatctttatctaaaaataccattgtaggtgacgaatatcgcattagatatctcatcgcatacctcactactaaatttggtattaaaatttacgatctgtctgctctagatattaagattattcgacaatttttatttgagagtggtactaatataagacctactacgcacctttctgatatctttgttttttttgatacgcttttcattttaacc

SEQ ID NO: 10006 - protein, 206 aa, Streptococcus agalactiae
MIENFLEKNILNKVKLLTLCYDTPSLSLDTACNRLHLSPVELKNYCHKLNVLFGHKLSIHIQKKRILCKLNKLTQEDALKIVYNESNTLQLLKFLIDDSSDKKSLVAFGNDLFLSRSSVYRLRENLIPLIKDLGLSLSKNTIVGDEYRIRYLIAYLTTKFGIKIYDLSALDIKIIRQFLFESGTNIRPTTHLSDIFVFFDTLFILT

SEQ ID NO: 10007 - DNA, 840 bp, Streptococcus agalactiae
atggaaacatatactttatcgaatactcttaacattcctaaaattggttttgggacatggcaactaactgaaggtgaagaagcttataaggcagtgactcatgctttaaaagttggttatactcatattgatactgctcagatttatggtaatgaacatagtgttggacgtgctataagagacagtggtttggcaagagaaagtatctttttgacaactaagatttggaatgacaaacatgactatcatttagccaaagcttctattgatgaatctctgcagaaattaggtgttgattatattgatcttcttttgattcattggccaaatccaaaagctcttcgtgaaaatgatgcgtggaaagctgggaatgcaggcacttggaaagcgatggaagaagcttataaagaaggaaaggtaaaagctattggtgtttcgaatttcatgaaacatcacttagaggctttatttgaaactgccgaaataaaacctatggttaatcaaattatcctagcaccaggttgtgctcaagaggatttggttcgcttctgtaaaggaaatgatatcttattagaagcttacagtccatttggaacaggtgctatttttgaaaatgaatctataaaagctattgctgaaaaatatggtaaatcagttgcgcaagtagctcttcgctggtcacttgataatggctttttaccattacctaagtcagcgactcccaaaaatattgaagcaaaccttgatatttttgattttcaattaaacgaagatgatattgctaccttaatacaactagattcaggtattaaacccaaagatccagataatgtctcattt

SEQ ID NO: 10008 - protein, 280 aa, Streptococcus agalactiae
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 10009 - DNA, 672 bp, Streptococcus agalactiae
atgacaaaagaagatatcaaaaaacaagttcgaagagcttttgattttcgtatggcgattcgtgtttataataataatgatattcctaaagaagatatggagtatattttagatactgcttggttgagtccttcttcagtcggtttagaaggctggcgatttttggtactagatagacaaacaattgcaaaatttcgagataaacttaaggaagttgcttggggagcacaatatcaactagatactgctagtcactttgttttactactagctgaaaaaggtgcttattataacgctgatagcatgattaacagtctcattcgacgtggtctaggtgatccagctgcccttgagagtaggatacctctctacaaatccttccaagaaaacgatatgaaaattgattctgaacgttctctttgggattggacagcaaaacaaacttatatcgcactcggtaatatgatgacggctgctgctatgatcggcgtagattcatgcccaattgaaggatttgactatgaaaaggtcaataatatccttagtaaagaaggattaatagacgataagaaagaagctatttcttgtatggtttcatttggttatcgtttgcgtgaacctaaacattcccgtgctaggaaagaacgccaagaagtcattacttgggttgag

SEQ ID NO: 10010 - protein, 224 aa, Streptococcus agalactiae
MTKEDIKKQVRRAFDFRMAIRVYNNNDIPKEDMEYILDTAWLSPSSVGLEGWRFLVLDRQTIAKFRDKLKEVAWGAQYQLDTASHFVLLLAEKGAYYNADSMINSLIRRGLGDPAALESRIPLYKSFQENDMKIDSERSLWDWTAKQTYIALGNMMTAAAMIGVDSCPIEGFDYEKVNNILSKEGLIDDKKEAISCMVSFGYRLREPKHSRARKERQEVITWVE

SEQ ID NO: 10011 - DNA, 1644 bp, Streptococcus agalactiae
atgacaagtaaagcattaatatggtctatattacagattgatagtgctagagcttataatagttttttatattaccttcagaaaatcccctggttgggaagaaaaatccctaaccgatggtttaaaaccgatgatataaaaggtgtagtactatttattcgtatcattttctttttcttaagaggttttggtcgttccataggttacgtactatattgttatgttttatcattttttgttagaagtggcatgaagcagttaaatattttaccgcaagaaggttttaccctaactttaacattgatggtgattacctctcttttaattgtcataaatttctatataaaacttatagaacctaatgatatgcaacaaactcatatgattcgccttttcagaattgagccatcgaggtatttccaatccgctgaacttttagaagccagtagtgaactattttttagaagtttgagctttggcatatttttccatttaaatcactttgctttttggcatggtttgacttttgctttatttttagcaggtagtcgccttggaatcaaggtgctctgtttacctttatatggtagaggtaaagaccaagagaatccagagtctttactaaatattttattttacttagggattggtataggagtcttcctttctctctttttccttcttcttggcaaacagttctctccatatccatttttttcatggtacaccggtattgcaggacttatcatatggttagttagttactatcgattaaaaacttattctaaacttaaccacttgacctaccttaccctaacgcatgagacgatgaaggagaaaattgcaaagattgataatatagagctgcttgggattgaaatgaaagatagggatataaatgtcagtgaactttctcccctgctatttgaaaatttatcaggtatttcatatttaaacgctatctttttaaaacggatgagtatatacttgcaaaggaaaattttggtacgtttagctgttttaagtgttctgtttggaatagaactccttttcctgctattttttaaagaaaagataaatattccgatgaatgagcatagtttttcaaaattcctatttttgagtgcagttccaggatatctaatatatatcggtgaatcctattcaaaattttgtttctatcatttggatcgtccattattaagatataatttctatcgtgaaagagaaaatatcttagcaaccttaaaaatacgtttcctttatagtataaaacttaatttccccatttttgtagctttaaacatatgttttggaacctattattttaattttttcacccctaagattgatcagattatcatattagtaattacacaagctatatcaatgattttatttagtttttactttttgtatctttatttcttcttacagccttttacagaaggattaaaatcaaagagtgctatgtataatattttaacctttattatatactatatgggatataagctatttacctttactaaatctataacgatgccaatattattagtaagcctaggaattatagttgttattttaattattggctatttagcagttgtagtatttgctccaaaaactttccgtttaaaaagt

SEQ ID NO: 10012 - protein, 548 aa, Streptococcus agalactiae
MTSKALIWSILQIDSARAYNSFLYYLQKIPWLGRKIPNRWFKTDDIKGVVLFIRIIFFFLRGFGRSIGYVLYCYVLSFFVRSGMKQLNILPQEGFTLTLTLMVITSLLIVINFYIKLIEPNDMQQTHMIRLFRIEPSRYFQSAELLEASSELFFRSLSFGIFFHLNHFAFWHGLTFALFLAGSRLGIKVLCLPLYGRGKDQENPESLLNILFYLGIGIGVFLSLFFLLLGKQFSPYPFFSWYTGIAGLIIWLVSYYRLKTYSKLNHLTYLTLTHETMKEKIAKIDNIELLGIEMKDRDINVSELSPLLFENLSGISYLNAIFLKRMSIYLQRKILVRLAVLSVLFGIELLFLLFFKEKINIPMNEHSFSKFLFLSAVPGYLIYIGESYSKFCFYHLDRPLLRYNFYRERENILATLKIRFLYSIKLNFPIFVALNICFGTYYFNFFTPKIDQIIILVITQAISMILFSFYFLYLYFFLQPFTEGLKSKSAMYNILTFIIYYMGYKLFTFTKSITMPILLVSLGIIVVILIIGYLAVVVFAPKTFRLKS

SEQ ID NO: 10013 - DNA, 597 bp, Streptococcus agalactiae
gtgtcaatgcttatgacaaaaataataggactgacaggagggatagcttctggaaagtcaacggtaacaaaaataatacgagaatcaggttttaaagtcatagatgcggatcaagtggttcataaattgcaagctaagggtgggaaactttaccaagctttattagaatggttgggtcccgagatacttgatgctgatggtgagttggatagaccaaagctttctcaaatgatttttgctaatccagacaatatgaagacatcagctaggctacaaaatagtatcattcgtcaagagttagcatgtcagcgcgaccaattaaaacaaacagaagagatatttttcatggatattcctttattgattgaagaaaagtatataaaatggtttgatgagatttggttggtatttgttgataaagaaaaacaattacaacgattaatggcccgtaacaactacagtcgagaagaagcagaattacgactttcacaccaaatgcctttaacagataaaaaaagtttcgctagtcttattattgacaataatggtgatttaataactttaaaagagcaaatattggatgctcttcaacgttta

SEQ ID NO: 10014 - protein, 199 aa, Streptococcus agalactiae
MSMLMTKIIGLTGGIASGKSTVTKIIRESGFKVIDADQVVHKLQAKGGKLYQALLEWLGPEILDADGELDRPKLSQMIFANPDNMKTSARLQNSIIRQELACQRDQLKQTEEIFFMDIPLLIEEKYIKWFDEIWLVFVDKEKQLQRLMARNNYSREEAELRLSHQMPLTDKKSFASLIIDNNGDLITLKEQILDALQRL

SEQ ID NO: 10015 - DNA, 846 bp, Streptococcus agalactiae
atggaaaaagaattaggaaaaacactaagaagattacgtaaaggaaaaaaagttagtatttcttctttagcagatgagcacctatccaagtcacaaatctcaaggtttgagagaggagagtcagaaattacttgtagtcgtttgcttaatattttagacaaactcaacatcactattgatgaatttgtgtcgattcattctaaggcgcacactcatttttttatccttttaaatcgagtaagaaaatattgtgctgaaaaaaatgtaactaaattagtggctctcttagaggatcataaccataaagactatgaaaagattatgattaaggctcttattttttcaattgatcaatcaatagagcctaatcaagaagaattagcacgcttaacagactatctttttacggtggagcagtggggatattatgaaattattctcttaggaaattgctcacgtctcattaattacaatactttatttttattgaccaaagaaatggttaattcgtttgcttattcagaacaaaataaaaccaataaaatcctagttacacaattagcaattaattgtctaatcatcagcattgatcactcttactttgagcatagccactacttaattgataaggttagatcattgttacaggatgaagttaatttctatgaaaaaactgttttcttatatgtaactggatactatcatttaaaacttggtgatacttcttcaggaaaagaagatatgaggaaagctttacagatttttaaatatttaggtgaagattcattttacaatacttataatgaacattattgtcaaaaagtacttggcaataataaagaatgc

SEQ ID NO: 10016 - protein, 282 aa, Streptococcus agalactiae
MEKELGKTLRRLRKGKKVSISSLADEHLSKSQISRFERGESEITCSRLLNILDKLNITIDEFVSIHSKAHTHFFILLNRVRKYCAEKNVTKLVALLEDHNHKDYEKIMIKALIFSIDQSIEPNQEELARLTDYLFTVEQWGYYEIILLGNCSRLINYNTLFLLTKEMVNSFAYSEQNKTNKILVTQLAINCLIISIDHSYFEHSHYLIDKVRSLLQDEVNFYEKTVFLYVTGYYHLKLGDTSSGKEDMRKALQIFKYLGEDSFYNTYNEHYCQKVLGNNKEC

SEQ ID NO: 10017 - DNA, 897 bp, Streptococcus agalactiae
atgacatttaagtcaggatttgtagcaattttaggtcgtccaaatgttggaaaatcaaccttcctaaaccatgttatgggacaaaaaattgctatcatgagtgataaagctcaaacaacacgtaataaaattatggggatttatacaacagaaactgagcaaattgttttcattgataccccaggaattcataaaccaaagaccgcccttggtgattttatggttgaatctgcttatagtactttacgtgaagttgaaacagttcttttcatggttcctgccgatgaaaagcgaggcaaaggcgatgatatgattattgaacgtcttaaggctgccaagattcctgttattttagtaatcaacaaaattgataaggttcatccagaccaacttttggaacagattgatgacttccgtagtcaaatggattttaaagaagtagtgccaatttctgcccttcaaggaaataatgtgccaaccctaatcaagttattgactgataatcttgaagaaggtttccaatatttcccagaagatcagattactgatcatccggaacgatttttagtatcagaaatggttcgtgagaaggtacttcatttaacgcaacaagaggttcctcactcagtagctgttgttgtcgaatccatgaaacgtgatgaagaaactgataaagtgcatattcgtgcaactatcatggttgaacgtgatagtcaaaaaggcattatcattggaaaacaaggtgctatgctcaagaaaataggaaaaatggcgcgccgtgatattgaacttatgttaggtgataaagtttacctagagacttgggtaaaagtcaagaaaaactggcgtgataaaaagcttgatttagctgattttggctataatgaaaaagagtat

SEQ ID NO: 10018 - protein, 299 aa, Streptococcus agalactiae
MTFKSGFVAILGRPNVGKSTFLNHVMGQKIAIMSDKAQTTRNKIMGIYTTETEQIVFIDTPGIHKPKTALGDFMVESAYSTLREVETVLFMVPADEKRGKGDDMIIERLKAAKIPVILVINKIDKVHPDQLLEQIDDFRSQMDFKEVVPISALQGNNVPTLIKLLTDNLEEGFQYFPEDQITDHPERFLVSEMVREKVLHLTQQEVPHSVAVVVESMKRDEETDKVHIRATIMVERDSQKGIIIGKQGAMLKKIGKMARRDIELMLGDKVYLETWVKVKKNWRDKKLDLADFGYNEKEY

SEQ ID NO: 10019 - DNA, 483 bp, Streptococcus agalactiae
atgattgatgaaactggacaagtttcagaagatatcaaaaagcaaactcttgatttgttagagtttgcagcacaaaaaacaggtaaagagaataaagaaatggctgtaacgtttgtcactaatgaacgtagccatgaattgaatttagagtatcgagataccgatcgtccgactgatgttatcagtttagaatataagcctgaggttgatatttcttttgatgaagaagatctggctgaaaatcctgaacttgctgagatgctagaagattttgattcttatattggtgaactttttatttctattgataaagctaaagaacaagcagaagagtacggtcactcttatgaacgtgaaatgggttttttagctgtacatggttttttgcatattaacggttatgatcattatacacccgaagaagaaaaagagatgttcagcttacaggaagaaattttaactgcttatggacttaaacgacaa

SEQ ID NO: 10020 - protein, 161 aa, Streptococcus agalactiae
MIDETGQVSEDIKKQTLDLLEFAAQKTGKENKEMAVTFVTNERSHELNLEYRDTDRPTDVISLEYKPEVDISFDEEDLAENPELAEMLEDFDSYIGELFISIDKAKEQAEEYGHSYEREMGFLAVHGFLHINGYDHYTPEEEKEMFSLQEEILTAYGLKRQ

SEQ ID NO: 10021 - DNA, 507 bp, Streptococcus agalactiae
atggaacgtgcgatttttgctggaggttgtttttggtgtatggtacaaccatttgaagaattagatggtattgaatctgttttatctggatacactggaggacatgttgagaatccaacttataaagaagtttgtagtaaaactactggacatacagaagctgttgaaattatttttaatcctgaaaaaatctcttatgcagatttagttgagttatattgggcacaaacagatccaacagacgcttttggtcagtttgaagatcgtggggataattatcgtcctgtcatcttttatgagaatgaagagcaacgtcagattgctcaaaaatcaaaagataagctacaagcttcgggtagatttgatagaccaattgtaaccagcattgagcctgctgatactttttacccagcagaagactatcatcaagcattctatcggactaaccctgctcgttacgccttgagtagtgccagaagacatgcatttctagaggagaactggcat

SEQ ID NO: 10022 - protein, 169 aa, Streptococcus agalactiae
MERAIFAGGCFWCMVQPFEELDGIESVLSGYTGGHVENPTYKEVCSKTTGHTEAVEIIFNPEKISYADLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 10023 - DNA, 852 bp, Streptococcus agalactiae
atgaatacattattagcgacagtcataacaggcttagtaactgatgaaaacaaagatttttactttatccaaaaagatggctttacctttgcattatcaaagtcagaaggagagcatcacattggtgaaatggttaaaggattcgcctatacagatatgcaacaaaaagcacgtcttacaactaaagaaacatttgcgactcgagatcattatggttgggggacagttactgaggtacgtaaagacttgggagtatttcttgatactggtcttccagataagcaagtggttgtttctttggatgttcttcctgaattgaaagaactttggcctaaaaaaggtgatcgcctctacgtttgcttagatgttgataaaaaagatcgtctctgggctctccctgcagatcctgaagtgtttcaacgaatggcaacccctgcatataacaatatgcaaaatcaaaattggccagcaatcgtttatcgcttaaaattgtcaggaacttttgtttatctaccagaaaataatatgctcggctttattcaccctagtgaacgttacagtgaacctcgtttagggcaagtgctggatgcacgagttattggcttcagagaagttgatagaaccttaaatttatcattaaagcctcgttcttttgaaatgttagaaaatgacgcacaaatgattttaacgtatttagaaagtaacggaggattcatgactttaaatgataaatcttctccagaggaaattaaagctacttttggaatttccaaaggtcagtttaaaaaagcacttggaggactcatgaaagctaaaaagatcaaacaagatcagctaggtacagaattatta

SEQ ID NO: 10024 - protein, 284 aa, Streptococcus agalactiae
MNTLLATVITGLVTDENKDFYFIQKDGFTFALSKSEGEHHIGEMVKGFAYTDMQQKARLTTKETFATRDHYGWGTVTEVRKDLGVFLDTGLPDKQVVVSLDVLPELKELWPKKGDRLYVCLDVDKKDRLWALPADPEVFQRMATPAYNNMQNQNWPAIVYRLKLSGTFVYLPENNMLGFIHPSERYSEPRLGQVLDARVIGFREVDRTLNLSLKPRSFEMLENDAQMILTYLESNGGFMTLNDKSSPEEIKATFGISKGQFKKALGGLMKAKKIKQDQLGTELL

SEQ ID NO: 10025 - DNA, 678 bp, Streptococcus agalactiae
atgttggtttgtaatcatgtcggaaaaacatttggacgacaagaggttttaaaggactgtcattttcatcttaaaagaggagaaataattggtataatgggtaaaagtggcagtggtaaaagtagccttgcccgactcattataggactagatagtcctacttgtggttcgatatattttcaaggaaaaatttacacacctaaagatggtaaggcgcagattatccttgtttttcaagatgcgcttagttcggtcaatccatattttagtattgaggaaattttgaatgaagctttttatggaaaaaaaacaacttttgaattatgtcaaatattagaagcggtgggtttagatggaacttatctaaaatataaagctagacaacttagtggtggtcagctacagagagtttgtatcgctagagctttactcttaaagcctaaaattattatttttgatgaatccttaagtggattagacccagtaactcaaattaaaatgctacgtttattacaaaaaataaaacgccgttatgaattaagttttataatgatttctcatgaccctaaaatttgtcaagctatctgtaaccgggtctttctgataaaaaatggttatttagtagaagataatgaattcttgaagagagcgtgttctactaactgtttgaccaatctc

SEQ ID NO: 10026 - protein, 226 aa, Streptococcus agalactiae
MLVCNHVGKTFGRQEVLKDCHFHLKRGEIIGIMGKSGSGKSSLARLIIGLDSPTCGSIYFQGKIYTPKDGKAQIILVFQDALSSVNPYFSIEEILNEAFYGKKTTFELCQILEAVGLDGTYLKYKARQLSGGQLQRVCIARALLLKPKIIIFDESLSGLDPVTQIKMLRLLQKIKRRYELSFIMISHDPKICQAICNRVFLIKNGYLVEDNEFLKRACSTNCLTNL

SEQ ID NO: 10027 - DNA, 705 bp, Streptococcus agalactiae
atgggagaatcgctaactattattggtgagagtggttcagggaaaaccctcttggcaaaattattggttggtcacattccacaaggtatgacagttagaggaaacatattttttaagggagttgatttaggtaaactaactgtaaagcagtggcagaaattaaggggacgagatattgcctatttagtgcaaaatcccatgtctatgtttaatccttttcaaaaaattgaagcgcatattttggaaacaatccttagtcatgagaaatgttcaaagagagtagccttatctaaagcgttagaatggatgaaacgtttaaatttagatgatgcgatatccctgttaaaaaaatacccttttgagcttagtggaggaatgctacaaagaattatgttagccactatattatctcttgatcctcaggtaatcatattagatgagccgacctcagcggttgattgtcataattgttctactatatcagctattttgcaggaattgcaaaataatggaaaaaccttgattactgtaacgcatgattatcagttagctagagacctggggggacaattattagttataagtgagggagaagttgttgaacagggacaaacccaagctattttaagcaatcctcaacataactatacgaaagcactgacagtgcaaatggagtatgaaggagatattcttaatgttggtttg

SEQ ID NO: 10028 - protein, 235 aa, Streptococcus agalactiae
MGESLTIIGESGSGKTLLAKLLVGHIPQGMTVRGNIFFKGVDLGKLTVKQWQKLRGRDIAYLVQNPMSMFNPFQKIEAHILETILSHEKCSKRVALSKALEWMKRLNLDDAISLLKKYPFELSGGMLQRIMLATILSLDPQVIILDEPTSAVDCHNCSTISAILQELQNNGKTLITVTHDYQLARDLGGQLLVISEGEVVEQGQTQAILSNPQHNYTKALTVQMEYEGDILNVGL

SEQ ID NO: 10029 - DNA, 1596 bp, Streptococcus agalactiae
ttgagcattacttgtttattgatggtgactctgactgcatgccattcacaggatagcaaaagtcataaactaaacagtgataaactcacgcttgcttggggagaagactttggtgatgttaatccgcatcgctataaccctgatcagtttgttatccaggatatggtttatgaggggttggtacgatatggtgacaatgggaaaattgaaccagctttagcgaaaagctggagcattagtcaagatggaaaaacctacacttttaaattgagaaatgctaaatattctgatggcagtaactttaatgctgcgaatgtcaaacgtaattttgatagtattttttcgaagtctaatagaggtaatcataattggtttaatttaacgaatcaattggaaaattatcgtgccttgaatcaaagtacttttgaaattaaactgaaacaagcttatagtgctactttatatgatctctctatgattcgaccaattcgctttttatctgatagcgctttccctaaaggtgatgatacaactaagaagaatgtaaaaaaaccaattggaacgggtcaatgggttgtgaaaagtaaaaagcaaaatgaatatattaccttcaaacgtaatgagaattactggggaaagaaaccaaaattaaaagaagtaaccgtaaaagttatacccgatgctcagacgcgtgctttagcattcgaatcaggtgacgttgatttgatctatgggaatggcattattggtttagacacttttgcccaatatacgaaggacaagaaatatgtcacagctatttctcaacctatgtcaacaagacttttgttgctaaatgctaaggaaagtattttccaagataaaaaagttcgtcaggcaatgaatcatgctattgacaaggtttctattgctaagaacacctttagaggaacagaaaagccagcagacactattttttcaaaatcaacatctcactcagatgctaagttaaatccttatagctataatgttgataaagcaaatcagctattggatcaagctggttggaagatgggaaaagataaggttcgtgaaaaagatggtaaaactctaaccttacgtcttccttatatcgccactaaggcaactgataaagacctggtaacttatttccaaggagaatggcgtaaaatcggtattaatgtttctcttattgctatggaagaagatgattattgggctaatgctaaaaagggtaattttgatatgatgttaacctattcttggggagcaccatgggaccctcatgcttggatgtcggcattaactgccaaggcagatcatggacatccagaaaatatagctttagaaaatctagcaactaaaactgaaatggatagacttattaagtcagctctagtagatcctaaggaagaaaatgttgatagagactataagaaggttcttgaattattgcatgatgaggctgtatatatcccattaacttatcaatcggtgatttctgtttataggaaaggtgattttaaaaccatgcgttttgcgccagaagaaaattcattcccattacgctatatagaaaaaaacaatgtatctaag

SEQ ID NO: 10030 - protein, 532 aa, Streptococcus agalactiae
MSITCLLMVTLTACHSQDSKSHKLNSDKLTLAWGEDFGDVNPHRYNPDQFVIQDMVYEGLVRYGDNGKIEPALAKSWSISQDGKTYTFKLRNAKYSDGSNFNAANVKRNFDSIFSKSNRGNHNWFNLTNQLENYRALNQSTFEIKLKQAYSATLYDLSMIRPIRFLSDSAFPKGDDTTKKNVKKPIGTGQWVVKSKKQNEYITFKRNENYWGKKPKLKEVTVKVIPDAQTRALAFESGDVDLIYGNGIIGLDTFAQYTKDKKYVTAISQPMSTRLLLLNAKESIFQDKKVRQAMNHAIDKVSIAKNTFRGTEKPADTIFSKSTSHSDAKLNPYSYNVDKANQLLDQAGWKMGKDKVREKDGKTLTLRLPYIATKATDKDLVTYFQGEWRKIGINVSLIAMEEDDYWANAKKGNFDMMLTYSWGAPWDPHAWMSALTAKADHGHPENIALENLATKTEMDRLIKSALVDPKEENVDRDYKKVLELLHDEAVYIPLTYQSVISVYRKGDFKTMRFAPEENSFPLRYIEKNNVSK

SEQ ID NO: 10031 - DNA, 1164 bp, Streptococcus agalactiae
atgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 10032 - protein, 388 aa, Streptococcus agalactiae
MTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGVKKGQRIYHILKTNDLEVSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 10033 - DNA, 882 bp, Streptococcus agalactiae
atgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaag

SEQ ID NO: 10034 - protein, 294 aa, Streptococcus agalactiae
MYLESIELYSNITKAAAHLFISQPYLSKVIKQLENELEIKLIQSQGHQTFLTYAGQRYLFYLKEIDMIERQMAKELYLIRSDKKGEITLGINSGLASSILANVLPKFNLEHPEISVKLLENNQNISEQLVASGDIDLAVGMAPILYKDGIASTTIYRDELFLMIPTTSQLYNAEKRGQIIPFEYPISVLDNEPLILTPLEYGIGKTIAQFYELHHMSLNQMITTSTVPTAASLSLSGMGATFVPQTLIHRYLDKECNVYHFHKNKLFSEYIMIYKKDVELSGIALLLYKAFLTK

SEQ ID NO: 10035 - DNA, 2355 bp, Streptococcus agalactiae
atgattactgctcttgttttaacaattattctcttctttggtattatcagattaggtatttttggtattacagtctataacgtcatccgttttatggtaggtagcttggcttacttatttattgcggcaactttaatctacctttatttctttaaatggttgcgaaagaaagatagcttagtagcaggttttttgatagcttctttaggattattgattgagtggcatgcttaccttttctcaatgcctattttgaaagataaagaaattttgcgttcaactgctcgattaattgtgtctgatttaatgcaatttaaaatcactgtttttgccggtggaggtatgttgggtgctttgatttacaagccaattgcttttctcttttctaatattggtgcctatatgattggtgttctcttcatcattttgggtctctttttaatgagttctctggaagtttatgacatcgtcgaatttattagagcttttaaaaataaagtggcagagaagcacgagcaaaataaaaaggagcgttttgctaagcgagagatgaaaaaagcaatcgctgaacaagagcgcatagagcgtcaaaaagctgaagaagaagcttatttagcttcggttaatgtagaccctgaaacgggtgagattctagaggatcaagctgaggacaatttggatgatgcgctaccacctgaggtaagtgaaacatcaactccggtatttgagccagagatccttgcttatgagacatcgcctcaaaatgatcctttaccagtagagccgacaatttatttagaagactatgattcgccgattcctaatatgagagaaaatgatgaggaaatggtttatgatttagatgatgatgtagatgatagtgatatagaaaatgtcgactttacacctaaaacgacactggtttataaattaccaacgatagatttatttgcaccagataagcctaaaaatcaatccaaagaaaaggatttagtccgaaagaatatcagagttttagaagaaacatttagaagttttggtatcgatgtaaaagtagaacgtgctgaaattggaccatcagttactaaatatgaaattaaaccagcagttggagttcgtgtgaatcgtatttcaaatctatctgacgacctagctcttgctcttgcagcaaaagatgtgcgtatagaaacaccaattcctggaaaatcattaataggtattgaagttcctaactcagaaattgcaacggtttctttccgcgaactttgggaacaatctgatgccaatcctgaaaaccttttagaagtaccactaggaaaagctgttaacggcaatgctcgcagttttaacttagctagaatgccgcatcttttggtagctggttcaactggttcaggtaaatctgtggcagttaatggaattatttcaagtattttgatgaaggcacgtccagatcaagttaagtttatgatgattgatcccaaaatggttgaattatctgtttataatgatattccacatttattaatccctgttgtaaccaatccgcgtaaagcaagtaaggcactccaaaaagttgttgatgaaatggaaaatcgatacgagttatttagcaaaattggtgtgcgtaatatagcaggttataatacaaaggttgaagagtttaatgcttcctctgagcaaaaacaaatacctttgcctttaatcgttgtcattgtagatgaattggctgacttgatgatggttgctagtaaagaagttgaagatgctattattcgtttggggcaaaaagcacgtgctgcaggtatccatatgattcttgcaactcaacgtccatccgtagatgttatttctggtttgattaaagcaaatgttccgtcgcgtattgcatttgctgtttcaagtggtactgatagccgtacgatccttgatgaaaatggtgctgaaaagctcttgggacggggtgacatgctctttaagcctattgatgagaatcatccagtacgactacaaggttcctttatttcagatgatgatgttgaaaggatcgttggttttatcaaagaccaagccgaggctgactatgatgatgcctttgatcctggagaagtatctgaaacagataacggctctggtggtggcggcggagtacctgaaagtgatcctctttttgaagaagccaagggactcgttttagagacgcaaaaagcaagtgcctcaatgattcaacgccgattgtctgttggtttcaatagagcaacaagactaatggaagaattagaagcagcgggggttattggtccagcagaaggaaccaagccacgaaaagttttaatgactccaactccgagtgaa

SEQ ID NO: 10036 - protein, 785 aa, Streptococcus agalactiae
MITALVLTIILFFGIIRLGIFGITVYNVIRFMVGSLAYLFIAATLIYLYFFKWLRKKDSLVAGFLIASLGLLIEWHAYLFSMPILKDKEILRSTARLIVSDLMQFKITVFAGGGMLGALIYKPIAFLFSNIGAYMIGVLFIILGLFLMSSLEVYDIVEFIRAFKNKVAEKHEQNKKERFAKREMKKAIAEQERIERQKAEEEAYLASVNVDPETGEILEDQAEDNLDDALPPEVSETSTPVFEPEILAYETSPQNDPLPVEPTIYLEDYDSPIPNMRENDEEMVYDLDDDVDDSDIENVDFTPKTTLVYKLPTIDLFAPDKPKNQSKEKDLVRKNIRVLEETFRSFGIDVKVERAEIGPSVTKYEIKPAVGVRVNRISNLSDDLALALAAKDVRIETPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRIAFAVSSGTDSRTILDENGAEKLLGRGDMLFKPIDENHPVRLQGSFISDDDVERIVGFIKDQAEADYDDAFDPGEVSETDNGSGGGGGVPESDPLFEEAKGLVLETQKASASMIQRRLSVGFNRATRLMEELEAAGVIGPAEGTKPRKVLMTPTPSE

SEQ ID NO: 10037 - DNA, 234 bp, Streptococcus agalactiae
atgacatttgaagaaattttaccaggtttaaaagcaaagaaaaaatatgtacgtacaggttgggggggcgctgaaaattatgttcagttatttgatacccttgaagttaatgggaaagtactacaggctacaccttattttcttattaatgttactggtgaaggtgaaggtttttccatgtgggcaccaacaccatgtgatgttttagcagaggattggatcgaggtcaatgac

SEQ ID NO: 10038 - protein, 78 aa, Streptococcus agalactiae
MTFEEILPGLKAKKKYVRTGWGGAENYVQLFDTLEVNGKVLQATPYFLINVTGEGEGFSMWAPTPCDVLAEDWIEVND

SEQ ID NO: 10039 - DNA, 1203 bp, Streptococcus agalactiae
gtgagttcgattgattcgttattgcaccttgattatgaagcgtatgaaattatcgttgtggatgacggttccagtgacaatacttcagatgttctcaaggaagagtttgcattaatgaaaatctcgaatacgattgattcaattattgctactcaaacttgtaaagatgtctttcagagacaggttggtaaggttaaactgacactcattgttaaagaaaatggtggcaaaggggatgccttaaatatggggatcaatgctgctaattacgattattttctatgtctagatgcagattctatgttgcaggtagattctttgagtcaaattagcaaatccatacaggtagatccgacggttatagcagtgggagggctcgtccaagttgcccaaggtgttaagattgagcaggggaaagtagcatcttatcgtttgccttggagaattattccttgtgcacaagcacttgagtatgattcatcatttttaggagctcgaatctttttagactatttaagagctaatttaattatttcgggggctttcggtctttttaagaaagaccttgttaaagcggtgggaggatatgacacccagactctaggagaagatatggagttggtgatgaaattacatttcttctgtcgtaataataatattccttatcgtatttgttatgaaacagatgctgtttgttggagtcaagcaccaacgaatttaggggatttacgtaaacagagacgccgatggtatcttggcttgtaccaatgtttaaaaaaatataaaagtatttttgccaattatcgctttggagctgtaggatcaatttcttatatttactatattttatttgaattactgaccccttttatagaatgttttggtattgtcattatatttttgtccttattatttaatcaattaaacatcccattctttatatcattggtgagcctttatatcttttactgtgttttaattacattaagctctttcttacaccgtatttattctcagcaactagtaataggaattttagatattgttaaagtattttatattgctgtttttaggtatcttatcctacatcctgtattaacttttgttaaggttgcaagtgttattggctataaaaataaaaaaatggtttgggggcatattacgagagagaaacaaatgaaggattttgaaacaagtgttact

SEQ ID NO: 10040 - protein, 401 aa, Streptococcus agalactiae
MSSIDSLLHLDYEAYEIIVVDDGSSDNTSDVLKEEFALMKISNTIDSIIATQTCKDVFQRQVGKVKLTLIVKENGGKGDALNMGINAANYDYFLCLDADSMLQVDSLSQISKSIQVDPTVIAVGGLVQVAQGVKIEQGKVASYRLPWRIIPCAQALEYDSSFLGARIFLDYLRANLIISGAFGLFKKDLVKAVGGYDTQTLGEDMELVMKLHFFCRNNNIPYRICYETDAVCWSQAPTNLGDLRKQRRRWYLGLYQCLKKYKSIFANYRFGAVGSISYIYYILFELLTPFIECFGIVIIFLSLLFNQLNIPFFISLVSLYIFYCVLITLSSFLHRIYSQQLVIGILDIVKVFYIAVFRYLILHPVLTFVKVASVIGYKNKKMVWGHITREKQMKDFETSVT

SEQ ID NO: 10041 - DNA, 693 bp, Streptococcus agalactiae
atgaacgaagttcttagacaggaaaaaaaatatttaatatcacttgaagattactatcttttatctaagaaattttcccaagtaatgacgctcgattcgcatagttcagacgacggctatactatccgttcgctatactttgattctttagaagatgttgattggcaagaaaaggaagatggtgttgagatacgaagaaagattcgtttgcgcaattatggtagtcaaagcaattttgcgaaattagaaatgaaacaaaaacaaggtgctaatcaaaaaaagcgctctctaaaattaagcaagacagatgctcaagcgctgattaatggtaacaatagtgttttattaaattatccggatacatttgctgcggagtgttattcaaggataacaacgcaactttatcaacctaaaacggttattgagtaccaaagaaaagcttttgttgctaaggaaaacaatatccgaatcacctttgaccaccatataataggtacagaggctagttatgatattttctcagaggatttaaatcaaaattatttattagatccttatcttgttattttagaagttaaatataatggatttttattgtcttatattaaagaactcttagattcggtagatagaagtgaactttcagcgagtaagtattgtttaggaagagctgttagtaaacattatcgtttt

SEQ ID NO: 10042 - protein, 231 aa, Streptococcus agalactiae
MNEVLRQEKKYLISLEDYYLLSKKFSQVMTLDSHSSDDGYTIRSLYFDSLEDVDWQEKEDGVEIRRKIRLRNYGSQSNFAKLEMKQKQGANQKKRSLKLSKTDAQALINGNNSVLLNYPDTFAAECYSRITTQLYQPKTVIEYQRKAFVAKENNIRITFDHHIIGTEASYDIFSEDLNQNYLLDPYLVILEVKYNGFLLSYIKELLDSVDRSELSASKYCLGRAVSKHYRF

SEQ ID NO: 10043 - DNA, 1995 bp, Streptococcus agalactiae
atgacagaaaaaaaatcattttacattactaccccaatttattacccatcaggtaaattgcacatcggttctgcctatacaacgatagcatgtgatgttttggcacgttacaaacgcatgatgggctttgatgttcagtatttgactggtcttgatgagcatggtcagaaaattcaacaaaaggctgaagaagcaggcattacaccacaggaatatgttgatggcatggctgaaagtgtcaaaacattatgggaacttttagatatttcctatgacaaattcatccgtacaacagatacttaccatgaagaagcggttgctaaaatttttgaacaattgttggcacaaggggacatctatcttggtgagtataccggatggtattctgtttcagatgaagaattttttactgaaagccaattagcagaagtttatcgtgacgaaaacggtaatatgattggtggtgttgcgccatctggtcatgaagttgaaaaagtttctgaagaatcttatttcttccgcatgagcaaatatgcagatcgtttaaaagcgtactacgctgagcatccagaatttattcagccagatggtcgtatgaatgaaatgcttaaaaactttatagaaccaggtttagaagatttagcagtgtctcgtacaacttacacatggggagttcaggtaccatcaaatccaaaacatgttatttatgtctggattgatgctttgatgaactatatttctgctcttggttatggttggtctgacgatctcagtcaatatcataaattttggccagcagacattcatatgattggtaaagatattcttcgtttccactctatttattggcctatcatgttgatggcgctggatttgccattaccaaaacgtctagttgctcatggttggtttgtgatgcaagatggtaaaatgtctaaatcaaaagggaatgtcgtttatccagaaatgttagtagagcgttttggtcttgatccactccgttattatctcatgcgttcattgcctgttggttcagacggaacttttacgccagaagattatgttggacgtattaactatgaacttgctaatgatttaggaaaccttctcaaccgcactattgctatggttaacaagtatttcgatggagaagtaccaaggtttgctgttgcaactgactttgatgccgatttagcttctgttgcgacagatagtattgaaaactatcataaacaaatggaagcggtggatttcccacgtgcccttgaagctgtatggaatcttatttcacgaactaacaaatatattgatgaaacagcaccgtgggtacttgcaaaagacgaaacagatcgtgataagttagcagctgtaatgagtcatttagttgctagtctacgtgttgttgctcacctcattcaaccgttcatgatggaaacttccgatgccattatggaacaacttggtttaggggcaacattcgatcttgaaaaattgacttttgctgatctaccagaaggtgttcgagttgttgcaaaaggttcaccaattttcccaaggttggatatggaagacgaaattacttatatcaaagaacaaatgaatgctggaaaagcaccagtggaaaaggagtgggttcctgaagaagttgaattgacatcaagcaaaggtcaaatcaagtttgaggattttgacgctgttgaaatccgcgttgcagaagtaattgaagttgagaaagtggaaggttctgataaacttcttcgtttccgtctagatgctggtgatgagggccatcgtcaaatcttatcagggattgcaaaattttacccaaatgaacaagagttagtagggaaaaaactccaaattgttgctaacctcaaaccacgtaaaatgatgaaaaaatatgtcagtcaaggcatgattctctcagcagaacatgatggtaaattgacagtgttgacggtcgattcagcagtggcaaatggatcaattattggt

SEQ ID NO: 10044 - protein, 665 aa, Streptococcus agalactiae
MTEKKSFYITTPIYYPSGKLHIGSAYTTIACDVLARYKRMMGFDVQYLTGLDEHGQKIQQKAEEAGITPQEYVDGMAESVKTLWELLDISYDKFIRTTDTYHEEAVAKIFEQLLAQGDIYLGEYTGWYSVSDEEFFTESQLAEVYRDENGNMIGGVAPSGHEVEKVSEESYFFRMSKYADRLKAYYAEHPEFIQPDGRMNEMLKNFIEPGLEDLAVSRTTYTWGVQVPSNPKHVIYVWIDALMNYISALGYGWSDDLSQYHKFWPADIHMIGKDILRFHSIYWPIMLMALDLPLPKRLVAHGWFVMQDGKMSKSKGNVVYPEMLVERFGLDPLRYYLMRSLPVGSDGTFTPEDYVGRINYELANDLGNLLNRTIAMVNKYFDGEVPRFAVATDFDADLASVATDSIENYHKQMEAVDFPRALEAVWNLISRTNKYIDETAPWVLAKDETDRDKLAAVMSHLVASLRVVAHLIQPFMMETSDAIMEQLGLGATFDLEKLTFADLPEGVRVVAKGSPIFPRLDMEDEITYIKEQMNAGKAPVEKEWVPEEVELTSSKGQIKFEDFDAVEIRVAEVIEVEKVEGSDKLLRFRLDAGDEGHRQILSGIAKFYPNEQELVGKKLQIVANLKPRKMMKKYVSQGMILSAEHDGKLTVLTVDSAVANGSIIG

SEQ ID NO: 10045 - DNA, 1095 bp, Streptococcus agalactiae
atgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaaaggaattacagtctttcctcatgtaggcggatcaacagatgaggcagagctaaattgtgctattatggcaagtcaaaccattcgttgttttatggagacaggagaaatcactaattcagttaatttccccaatgtacatcaaattcaaaccgcaccatttcgtattactttaattaacaagaatgttcctaacattgtggctaaaatttcaactgctgtatcagagttaggtataaatattgataacattattaaccgttcaaagggtgactacgcctacacactaatagatttagatgaaacggataataacaagatttctactttaattgaagaatttgaaggtgatgagaatatcgtccgtgtacgtttaattgcaaaacaacaa

SEQ ID NO: 10046 - protein, 365 aa, Streptococcus agalactiae
MSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQKGITVFPHVGGSTDEAELNCAIMASQTIRCFMETGEITNSVNFPNVHQIQTAPFRITLINKNVPNIVAKISTAVSELGINIDNIINRSKGDYAYTLIDLDETDNNKISTLIEEFEGDENIVRVRLIAKQQ

SEQ ID NO: 10047 - DNA, 546 bp, Streptococcus agalactiae
atgcaaatcagattagcttttccaaatgaaattgaccaaattatgcttcttattgaggaagcgcgtgccgaaattgctaaaacaggaagtgatcaatggcaaaaagaagatggataccctaatcgtaacgatattattgatgatatcttgaacggttatgcttgggttggtattgaagatgggatgctagcgacttatgcggctgtcattgatggtcatgaagaggtttatgatgctatttatgagggaaaatggctccatgataaccatcgctatcttacatttcatcgtattgcgatctcaaatcaatttcgtggtagaggactagcacagacattccttcaagggttaattgaaggtcataaaggacctgattttcgttgcgatactcatgaaaaaaatgtcactatgcagcatattctaaataaattaggctatcaatattgtggtaaagtacctctagatggggtacgattggcttatcagaagataaaagaaaagggagaaacgagcatctatcgtgagattgatgaaagaaatcccatg

SEQ ID NO: 10048 - protein, 182 aa, Streptococcus agalactiae
MQIRLAFPNEIDQIMLLIEEARAEIAKTGSDQWQKEDGYPNRNDIIDDILNGYAWVGIEDGMLATYAAVIDGHEEVYDAIYEGKWLHDNHRYLTFHRIAISNQFRGRGLAQTFLQGLIEGHKGPDFRCDTHEKNVTMQHILNKLGYQYCGKVPLDGVRLAYQKIKEKGETSIYREIDERNPM

SEQ ID NO: 10049 - DNA, 516 bp, Streptococcus agalactiae
atgatttatgcaggagctcaaaaaaatattggacctgctggtgtaacggtagttattatccgtgaagatatgattaatgaggaaccaactttatcatcaatgttggattataagattcagtcagatgctggttctctttataatacgccgcctgcttacagtatttacattgctaaattagtctttgaatgggtgaaaagtctaggtggtgttgatgctatggaaaaagctaatcgtgaaaaatcaggacttctctatgattatattgattcctcagaattttatagtaatcctgtcagagataaaaagagtcgttctctatgtaacattcctttcataactattaataaagatttagatgaaaaatttgtaaaggaagcgacagaacgtggatttaaaaatattaaaggacatcgttcggtaggtggtatgagagctagcctttataatgcctttcctaaacaaggtgtcatcgaattaattgattttatgaaaacatttgaagcagaaaataca

SEQ ID NO: 10050 - protein, 172 aa, Streptococcus agalactiae
MIYAGAQKNIGPAGVTVVIIREDMINEEPTLSSMLDYKIQSDAGSLYNTPPAYSIYIAKLVFEWVKSLGGVDAMEKANREKSGLLYDYIDSSEFYSNPVRDKKSRSLCNIPFITINKDLDEKFVKEATERGFKNIKGHRSVGGMRASLYNAFPKQGVIELIDFMKTFEAENT

SEQ ID NO: 10051 - DNA, 861 bp, Streptococcus agalactiae
atgcaagttcaaaaaagttttaaatcaaatatacattacggaacactctatctagtcccaactccaattggtaatctagatgatatgacttttcgtgccattaggattttaagagaagttgattttatttgtgcagaggatacacgaaatacgggacttttactcaagcactttgatattactactaaacaaattagttttcacgaacacaatgcttacgataaaatctctgggttaattgatttgttaaaagaagggaaatctttagcccaagtatctgatgcaggaatgccctctatttctgacccaggacatgaccttgtcaaggctgctattgaaggggatatcccagttgtatctataccaggagctagcgctggtattactgctctcatcgcttcaggtttagctccacaacctcatattttttatggcttcttacctcgtaagaaaggtcaacaaataactttctttgaaacaaagcaagattaccctgaaacacaaatcttttatgagtcaccgtttcgagtctctgatacgctaaaacacatgaaagagatttacggagatcgccaagttgttttagtacgcgaattgacgaaactctatgaagagtatcaaagaggaaccattagtcaacttttagagcatattgaaaaggtccctctcaaaggtgaatgcttaattattgttgatggtaagagagataccgagcgagtgaaagacagtagccaacaagatccactagtattagtaaaagaatatatcgctaatggtgataaaactaatcaagcgataaaaaaagtagcaaaagaatttaatctcaatagacaagaactctatgctagtttccatgattta

SEQ ID NO: 10052 - protein, 287 aa, Streptococcus agalactiae
MQVQKSFKSNIHYGTLYLVPTPIGNLDDMTFRAIRILREVDFICAEDTRNTGLLLKHFDITTKQISFHEHNAYDKISGLIDLLKEGKSLAQVSDAGMPSISDPGHDLVKAAIEGDIPVVSIPGASAGITALIASGLAPQPHIFYGFLPRKKGQQITFFETKQDYPETQIFYESPFRVSDTLKHMKEIYGDRQVVLVRELTKLYEEYQRGTISQLLEHIEKVPLKGECLIIVDGKRDTERVKDSSQQDPLVLVKEYIANGDKTNQAIKKVAKEFNLNRQELYASFHDL

SEQ ID NO: 10053 - DNA, 633 bp, Streptococcus agalactiae
atgaaaaaaggactaatgatttcttttgagggcccagatggtgcgggtaaaacaaccgttttagaagctgttttacccttgctcagagaaaaattatcacaagatattctcaccaccagagagcctggtggcgtaactatttcagaagaaattcgtcatattattttagatgttaaacacacgcaaatggataaaaaaacagagctattgctttacatggctgctcgacgccaacatctagtggaaaaggtactcccagctctagaagaagggaaaatagtcctaatggatcgttttattgatagttctgttgcctatcagggatcaggaagaggattagataagtcacatataaaatggcttaatgactatgcgactgatagtcataaacctgatttaactttatattttgatgttccttctgaagtaggtttagagcgtattcaaaaaagtgttcaaagggaggtaaatcgtctagatctcgagcaattagatatgcatcaacgcgtccgtcaaggttaccttgaattggcggattcggagccaaaccgcattgtgacgattgatgcctcccaacagctagatgaagtaatagctgagacattctctattattttagatcgtatcaaccaa

SEQ ID NO: 10054 - protein, 211 aa, Streptococcus agalactiae
MKKGLMISFEGPDGAGKTTVLEAVLPLLREKLSQDILTTREPGGVTISEEIRHIILDVKHTQMDKKTELLLYMAARRQHLVEKVLPALEEGKIVLMDRFIDSSVAYQGSGRGLDKSHIKWLNDYATDSHKPDLTLYFDVPSEVGLERIQKSVQREVNRLDLEQLDMHQRVRQGYLELADSEPNRIVTIDASQQLDEVIAETFSIILDRINQ

SEQ ID NO: 10055 - DNA, 549 bp, Streptococcus agalactiae
atgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgat

SEQ ID NO: 10056 - protein, 183 aa, Streptococcus agalactiae
MTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGGQEGPTYLSYPQNQRSRSEFFNRLSTHQERLPIHHTNRPTQSCEVQKKAKEHTPSYSKSD

SEQ ID NO: 10057 - DNA, 744 bp, Streptococcus agalactiae
gtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 10058 - protein, 248 aa, Streptococcus agalactiae
MSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 10059 - DNA, 798 bp, Streptococcus agalactiae
atggtatatggcattattaagctgattaattttgctcatggggacatctatatgatgggcgctttcatgggctattatttgattaatcatcttcatcttaattttttcctagctttattaattgcaatgctggggtctgctttcctaggtgttgtaattgaatatttagcttatcgtccactgagaaaatcaactagaattgccgcgttaattacagctattggtgtttcttttcttttggagtacgggatggtataccttgttggagcggatactagggcatttccgcaagccattcatactgttaaatataatttaggaccgataactataaccaatgttcagctcatcattttaggtattgcgctattactaatgcttactttacagttcatcgttcaaaaaactaaaatggggaaagctatgagagctttatcagtggatagcgatgccgcacaattgatgggaattaatgttaaccgtaccattagttttacatttgcgctggggtctgctttagctggagcaggtggagtactgattgggctttattataattctgttcaacctcttatgggggtaactccagggttgaaagcatttgttgcagctgtcttaggtggtattggtatcattccgggagcggctatcggtggttttgttattggcattttagaaactttagcgactgcacttggtgtgtcagattttcgagatggtatcgtttatgctattttaattctcattttcttgatccgtccagcaggaattcttggaaaaaatattaaggagaaggtc

SEQ ID NO: 10060 - protein, 266 aa, Streptococcus agalactiae
MVYGIIKLINFAHGDIYMMGAFMGYYLINHLHLNFFLALLIAMLGSAFLGVVIEYLAYRPLRKSTRIAALITAIGVSFLLEYGMVYLVGADTRAFPQAIHTVKYNLGPITITNVQLIILGIALLLMLTLQFIVQKTKMGKAMRALSVDSDAAQLMGINVNRTISFTFALGSALAGAGGVLIGLYYNSVQPLMGVTPGLKAFVAAVLGGIGIIPGAAIGGFVIGILETLATALGVSDFRDGIVYAILILIFLIRPAGILGKNIKEKV

SEQ ID NO: 10061 - DNA, 588 bp, Streptococcus agalactiae
atgattccagtagttattgaacaaacaagtcgtggtgaacgttcttatgatatttactcacgtcttttaaaagatcgtattattatgttgacaggccaagttgaggataatatggccaatagtatcattgcacagttattgtttctcgatgcacaagataatacaaaggatatttacctttatgtcaatacaccaggtggttcagtatcggctggacttgctattgtggacaccatgaacttcattaaatcggacgtacagacgattgttatggggatggctgcttcgatgggaaccattattgcttcaagtggtgctaaaggaaaacgttttatgttaccgaatgcagaatatatgatccaccaaccaatgggcggaacaggcggaggtacacagcaatctgatatggctatcgctgctgagcatcttttaaaaacgcgtcatactttagaaaaaatcttagctgataattctggtcaatctattgaaaaagtccatgatgatgcagagcgtgatcgttggatgagtgctcaagaaacacttgattatggctttattgatgctattatggaaaataataatttacaa

SEQ ID NO: 10062 - protein, 196 aa, Streptococcus agalactiae
MIPVVIEQTSRGERSYDIYSRLLKDRIIMLTGQVEDNMANSIIAQLLFLDAQDNTKDIYLYVNTPGGSVSAGLAIVDTMNFIKSDVQTIVMGMAASMGTIIASSGAKGKRFMLPNAEYMIHQPMGGTGGGTQQSDMAIAAEHLLKTRHTLEKILADNSGQSIEKVHDDAERDRWMSAQETLDYGFIDAIMENNNLQ

SEQ ID NO: 10063 - DNA, 516 bp, Streptococcus agalactiae
atgttaatgggctatgaagtgtctcgtgatttgcctttagaagatgttgaaatccaaacaccagtagcgacaactgtacaaaaacaattagctgggaaaaagttagcaattgttccaattttacgtgcaggtattggtatggttgatggtttcttaagccttgtgccagctgctaaagttggtcatatcggtatgtatcgtgatgaagagactttccaaccagtcgaatatttagttaagttacctgaagatattgatcaacgtcagatttttgtagttgatccaatgcttgctacaggtgggtctgctattttagcagtagattctctaaaaaaacgtggcgcagctagtatcaaattcgtttgtttagtagcagctccagaaggagtggcagcacttcaagaagcacatccagatgtagatatttataccgctgctttggatgaaaaactcaacgaacatggctacattgttcctggactcggagatgctggggatcgcttatttggtacaaaa

SEQ ID NO: 10064 - protein, 172 aa, Streptococcus agalactiae
MLMGYEVSRDLPLEDVEIQTPVATTVQKQLAGKKLAIVPILRAGIGMVDGFLSLVPAAKVGHIGMYRDEETFQPVEYLVKLPEDIDQRQIFVVDPMLATGGSAILAVDSLKKRGAASIKFVCLVAAPEGVAALQEAHPDVDIYTAALDEKLNEHGYIVPGLGDAGDRLFGTK

SEQ ID NO: 10065 - DNA, 1425 bp, Streptococcus agalactiae
atgattcgtttccttctctcaaaacttttgctaattgaagctgctcttctagcgattcctctaactgttggacttatttaccgtgaaccgcaaagtgtcatgatgagtatagtcattaccatgattattttaatcatccttggattactgggttctctctttaaacctaaaaattatcatatctacactaaagaaggcatgttaattgttgcactctgctggatactttggtccttctttggcgcccttccatttgttatttcagggcaaatccctaatattatcgatgctttctttgaagtatcttctggttttacgacaacaggagcaactattcttgatgacgtcagtgtcttatcacccgcgctcttattttggcgtagctttacccatcttatcggtggaatgggggttttagtatttgcccttgccatcatggaaaattctaaaaatagccatttagaggttatgagagctgaagttcctggacctgtatttggtaaagttgtctcgaaacttaaaaaaactgcacaaattttgtatttgttatatcttcttatgtttgcagtatttgcagtaatattatattttgcaggtatgcctttctttgatagtattatcatagcgatgggaactgcaggtacaggtggttttgcagtttacaatgatagcattgctcattataatagtcctctgataactaacttagtttctattggtatgcttatcttcggggttaactttaatctttactatcttcttttactccgaaaaattaaagcattctttggtgatgaggaactaaaaacctatctccgcatcgtggcaatagcaactttcatgattgctctaaacgtcatcggtatgtatgataattttcgacaaggcctcgaacatattttctttgaagtatcagctattattacgacaactggttttggcgtgactgatatcactcgttggcctttgttttcacaggttattttgctattcttgatgtttatcggtggttctgctggctctacagctgggggctttaaagtcatgcgtagcttaatcctagcaaagattgcacgtaaccaagtattgtctacactctatcctaatagagtcatgtcactacacattaataaaagcgttctagataaaaatacacaacatggtgttttaaaatatctaactatctatttagctatcttcatggcactcgttcttgttttaacgcttgatactaatgattttttggttgttatcagtgctgcagcctcatgttttaacaacataggcccactcttaggtagcaatgaaactttctcattctttagtccattctcaaaactccttctttcatttgctatgatagcaggacgtttagaaatataccctgttttattgatgtttattcctaaaacatggtcaaaacta

SEQ ID NO: 10066 - protein, 475 aa, Streptococcus agalactiae
MIRFLLSKLLLIEAALLAIPLTVGLIYREPQSVMMSIVITMIILIILGLLGSLFKPKNYHIYTKEGMLIVALCWILWSFFGALPFVISGQIPNIIDAFFEVSSGFTTTGATILDDVSVLSPALLFWRSFTHLIGGMGVLVFALAIMENSKNSHLEVMRAEVPGPVFGKVVSKLKKTAQILYLLYLLMFAVFAVILYFAGMPFFDSIIIAMGTAGTGGFAVYNDSIAHYNSPLITNLVSIGMLIFGVNFNLYYLLLLRKIKAFFGDEELKTYLRIVAIATFMIALNVIGMYDNFRQGLEHIFFEVSAIITTTGFGVTDITRWPLFSQVILLFLMFIGGSAGSTAGGFKVMRSLILAKIARNQVLSTLYPNRVMSLHINKSVLDKNTQHGVLKYLTIYLAIFMALVLVLTLDTNDFLVVISAAASCFNNIGPLLGSNETFSFFSPFSKLLLSFAMIAGRLEIYPVLLMFIPKTWSKL

SEQ ID NO: 10067 - DNA, 792 bp, Streptococcus agalactiae
atggatagtaggcctattggctttctagattctggtgtaggtggtttaacggttgttaaggaaatgttccgtcaacttccagaagaggaagtaatcttcattggagatcaggctagagctccgtatggtcctagacctgctcaacagattagagagtttacctggcagatggttaacttcttattgactaaaaatgttaagatgattgttatagcttgtaatacagcaactgcagttgcctggcaagaaattaaagaaaaactagacatccctgttttaggcgttattttaccaggagctagcgcagctatcaaatcaactaatttagggaaagttggtattataggtactcccatgactgttaaatcagatgcttatcgtcaaaaaattcaagctttgtctccaaatactgctgtggtatcccttgcttgtccgaaatttgttccaattgtggaatcaaatcagatgtcttctagtttagccaaaaaggtggtttatgaaacgttgtccccattagttggtaaattagatactttaattttaggttgcacgcattatcccctattacgtcccatcattcaaaatgttatgggggctgaggttaaattaattgatagtggcgcagaaaccgttcgtgatatttctgttttattgaactattttgagataaaccataattggcaaaataaacacggtggtcatcacttttacacaaccgccagcccaaaaggttttaaagaaattgcagaacaatggcttagtcaagaaataaatgtggagcgtatcgtatta

SEQ ID NO: 10068 - protein, 264 aa, Streptococcus agalactiae
MDSRPIGFLDSGVGGLTVVKEMFRQLPEEEVIFIGDQARAPYGPRPAQQIREFTWQMVNFLLTKNVKMIVIACNTATAVAWQEIKEKLDIPVLGVILPGASAAIKSTNLGKVGIIGTPMTVKSDAYRQKIQALSPNTAVVSLACPKFVPIVESNQMSSSLAKKVVYETLSPLVGKLDTLILGCTHYPLLRPIIQNVMGAEVKLIDSGAETVRDISVLLNYFEINHNWQNKHGGHHFYTTASPKGFKEIAEQWLSQEINVERIVL

SEQ ID NO: 10069 - DNA, 564 bp, Streptococcus agalactiae
atgtttccacaaaatatgattgccatcatgcaaaaaatgccagggttgtattttggagcaatcatcttagaattggttttagtctttgttgctagtggagcggcgcgtcgaaacacaccagctgcattaccattatttttgatttattcagctttgaatgggtttactttaagtttcattatcgcaaggtacacgcaaactacagttcttcaagcttttataacatctgcggctgttttctttgcaatggctttgattggagctaagactaaaaaagatttatcaggtatgcgtaaagcgttaatggctgctttaattgggattttaattgcaagtcttgttaatttatttatcggtagtgggggtatgagttatatcattagtatcgtatgtgtcatcatcttttctggattgattgcttacgataaccaaatgattaaatatgtctacaatagccaaggcggccaagtcgcagatggttgggcagtttcgatggcactaagcctttatcttgattttattaatctattcttaaatattcttcgtctttttgcacgaaatgat

SEQ ID NO: 10070 - protein, 188 aa, Streptococcus agalactiae
MFPQNMIAIMQKMPGLYFGAIILELVLVFVASGAARRNTPAALPLFLIYSALNGFTLSFIIARYTQTTVLQAFITSAAVFFAMALIGAKTKKDLSGMRKALMAALIGILIASLVNLFIGSGGMSYIISIVCVIIFSGLIAYDNQMIKYVYNSQGGQVADGWAVSMALSLYLDFINLFLNILRLFARND

SEQ ID NO: 10071 - DNA, 501 bp, Streptococcus agalactiae
atgaaaaagtatcaagacgataaggacttcatggatttggtcggtcaccttattgaccatccacgtttccaaaaactcgaagctattgtccaacatcatcactcaactcgcttagagcattctataaatgttagttatacaagttataaaattgctaagaagtttggttgggatgcgagtagtactgctcgaggtggtttactacatgatttcttttattatgattggcgtgtaacgaaatttaacaagagccatgcctgggttcatccaaggatagcggttcgtaatgcgcgaaaattaactgatttaaacgctagagaagaagatattattttgaagcacatgtggggagcgactattgcaccgccacgttataaagaaagttatattgtgactatggttgataagtattgggcagtacgagaggcttctcgtccactcaaacgtatttttaagaaacctatccgttttagtcgcaaattcttaggtagtcataatcat

SEQ ID NO: 10072 - protein, 167 aa, Streptococcus agalactiae
MKKYQDDKDFMDLVGHLIDHPRFQKLEAIVQHHHSTRLEHSINVSYTSYKIAKKFGWDASSTARGGLLHDFFYYDWRVTKFNKSHAWVHPRIAVRNARKLTDLNAREEDIILKHMWGATIAPPRYKESYIVTMVDKYWAVREASRPLKRIFKKPIRFSRKFLGSHNH

SEQ ID NO: 10073 - DNA, 276 bp, Streptococcus agalactiae
atgaaaaaagttcatttaattgtctcagggcgcgttcaaggagtcggatttcgctatgcaacttattccttagctttagaaataggtgatatttacggtcgcgtttggaataacgatgatggaactgttgaaattttagcacaatctacagattcaaataaaatgacacaatttattcagaaaattcgaaaaggaccttcaaaatggtctaaagtaacttatgttgatattaaactagataacttcgatgattttaatgactttaaaatgagtaat

SEQ ID NO: 10074 - protein, 92 aa, Streptococcus agalactiae
MKKVHLIVSGRVQGVGFRYATYSLALEIGDIYGRVWNNDDGTVEILAQSTDSNKMTQFIQKIRKGPSKWSKVTYVDIKLDNFDDFNDFKMSN

SEQ ID NO: 10075 - DNA, 798 bp, Streptococcus agalactiae
atggccaacctcattacttatttcgctcaacaccaagggcttggttttggtgtcgctatcattattgtaaccgtcatcgtacgtgtcgttatcttaccacttggactttatcagtcttggaaagctagctatcaagctgaaaaaatggcatactttaagcctttatttgaacctattaatgaacgactacgcaatgctaaaacacaagaagaaaaattagcagctcagacagaattaatgacagctcaacgtgagaatggccttagcatgtttggcggtattggctgcttgccattactcattcagatgccatttttctcagctattttctttgctgcacgctatactcctggagtctctagtgcaaccttcttgggacttaacttaggtcaaaagagtctgacacttactgtcattatcgccattctttattttgtacaatcttggttgtcaatgcaaggtgttccagatgaacaacgtcagcaaatgaaaacaatgatgtatctgatgccaataatgatggtattcatgtctattagtttacctgctagtgttgcgctttattggtttattggtggtattttcagtattatccagcagctagttacgacttatgtacttaagcctaaactacgccgaaaagtagaagaagaatatactaaaaatcctcctaaagcctacaaagctaataacgcacgaaaagatgttacaaattcaactaaagccactgaatctaatcaagcaattattacatctaaaaaaacaaatcgtaacgccggaaaacaaaaaagacgggga

SEQ ID NO: 10076 - protein, 266 aa, Streptococcus agalactiae
MANLITYFAQHQGLGFGVAIIIVTVIVRVVILPLGLYQSWKASYQAEKMAYFKPLFEPINERLRNAKTQEEKLAAQTELMTAQRENGLSMFGGIGCLPLLIQMPFFSAIFFAARYTPGVSSATFLGLNLGQKSLTLTVIIAILYFVQSWLSMQGVPDEQRQQMKTMMYLMPIMMVFMSISLPASVALYWFIGGIFSIIQQLVTTYVLKPKLRRKVEEEYTKNPPKAYKANNARKDVTNSTKATESNQAIITSKKTNRNAGKQKRRG

SEQ ID NO: 10077 - DNA, 501 bp, Streptococcus agalactiae
atgattattagaaatggttgcctagaggatttacagcaagtcattagtattgaacaaataaatttttcagaagcagaggctgcgagtaaaaaagcaatgcaagaacgtttaacgataatgactgatacttttttagttgcagagattaatggtcgtttagcaggttacattgaaggaccggttattaaaggtcggtacttaacggacgatttattccataaagtttctgaattccctgtaagggtaggtggtttcataggaattactagtctatcaatacatcctgattttaaaggtcaggggattggtacagcattattagcagcgatgaaagacctggttgtttctcaagaacgagatggtataagtttaacttgccatgatgatttaatttccttctatgaaatgaatggatttaaagatgagggagaatctgactccaaacatggtggttcgctttggtataatatgatttggaataatccaacacgatcaatttgt

SEQ ID NO: 10078 - protein, 167 aa, Streptococcus agalactiae
MIIRNGCLEDLQQVISIEQINFSEAEAASKKAMQERLTIMTDTFLVAEINGRLAGYIEGPVIKGRYLTDDLFHKVSEFPVRVGGFIGITSLSIHPDFKGQGIGTALLAAMKDLVVSQERDGISLTCHDDLISFYEMNGFKDEGESDSKHGGSLWYNMIWNNPTRSIC

SEQ ID NO: 10079 - DNA, 711 bp, Streptococcus agalactiae
atgacaccccaagcattttatcaagttctgatagagcatggtattacacttactgacaaacagaaaaaacaatttgaaacttattttagacttcttgttgaatggaatgagaaaattaacctaacagctattacagataaggaagaggtttacttaaagcacttctatgattctattgcgccgattttacaaggttatattgacaatagtcctcttagcattttagatattggtgctggtgcaggttttcctagtattcctatgaaaatcctttatcctgaaattgatattactattattgattcactgaataaacgcattaattttctaaacatattagctaatgaacttgaactttcaggagttcacttcttccatgggcgcgctgaggactttggtcaagatagagtatttcgagctaaatttgatatcgtaacagctcgtgcagtagctaaaatgcaggttctagcagaattgacaataccttttcttaaagttaatggtcgcttgattgcactgaaagctgcagctgctgaagaggaattaatttctgcagaaaaagctttgaaaacactattttcacaagtaactgtaaataaaaattataagttacctaatggtgatgaccgaaatatcacaatcgttagcaagaaaaaagaaacgcctaataaataccctcgtaaagctggtactccaaacaagaagcctttg

SEQ ID NO: 10080 - protein, 237 aa, Streptococcus agalactiae
MTPQAFYQVLIEHGITLTDKQKKQFETYFRLLVEWNEKINLTAITDKEEVYLKHFYDSIAPILQGYIDNSPLSILDIGAGAGFPSIPMKILYPEIDITIIDSLNKRINFLNILANELELSGVHFFHGRAEDFGQDRVFRAKFDIVTARAVAKMQVLAELTIPFLKVNGRLIALKAAAAEEELISAEKALKTLFSQVTVNKNYKLPNGDDRNITIVSKKKETPNKYPRKAGTPNKKPL

SEQ ID NO: 10081 - DNA, 1377 bp, Streptococcus agalactiae
atgaaacatttctttgattacaagacaatgtctgtcgcacgtaaactcagcattagttttatcgctgttatcctattgggaagtattttactttcacttccaatttttcaatatgctaacgcccctaaaacacattacattgatcaccttttcacgactgtttcaatggtatgtgtaactggtttatctgtttttcctatcagtaaggtttataacggttgggggcagattgtagctattttactcatgcaaacagggggacttggtttagtaacactaatgtcgttgtcttactataccctaagacgtaaaatgtcgttaaatgatcagacccttttgcagtcagcgataacttataacagttcgacagatttaaaaaaatatctctatatgatttttaaagtaactttaactttagaagttttagcagccagcattttagccatagattttattcctcgatttggtttgggtcatggtatctttaatagtatattcttagctgtctcagccttttgtaatgccggttttgataatctagaggcaacgagcttagctcaatttaaactaaatcctttggttaacattatcgtttgtttcttgattatttcaggaggacttggatttgccgtatggaaagatttaattgaagctactatacaaacatctcacaagggaccaaaattaatcaagacatttccaaaacgcctcagcaaccattctaaactggttttaaaaacaacaaccattattttactaacaggaactttgctttcttggttgttagagtttggaaattttagaacaattgctaatttatctctacctaaacaactaatggtcagctttttccaaacagttacgatgcgtaccgctggattttcaactattgattatacccaaactgatttcgcaaccaaccttgtttatattatccaaatgttaattggaggagctcctggtggaacggcaggaggatttaaagtcactgttatcgccattttactcttactatttaaagccgaactgagtggccaaagccaagtgacttttcattatcgaacaattccttccagtattattaaacaaacactatcgattttaactttcttttttatcatacttattagcggctatctccttcttctggaactcaatccccatatagatcctttttctcttttctttgaggcatctagtgccttagcaaccgtgggtgtaacaatgaacactaccaatcaattaactctgggcggtcgaattgtaattatgttcctcatgtttattggtcgagtcggtccaattaccgtactgctatcaattcttcagaaaaaagagaaggaaattcactatgctgaaacagaaattattctaggt

SEQ ID NO: 10082 - protein, 459 aa, Streptococcus agalactiae
MKHFFDYKTMSVARKLSISFIAVILLGSILLSLPIFQYANAPKTHYIDHLFTTVSMVCVTGLSVFPISKVYNGWGQIVAILLMQTGGLGLVTLMSLSYYTLRRKMSLNDQTLLQSAITYNSSTDLKKYLYMIFKVTLTLEVLAASILAIDFIPRFGLGHGIFNSIFLAVSAFCNAGFDNLEATSLAQFKLNPLVNIIVCFLIISGGLGFAVWKDLIEATIQTSHKGPKLIKTFPKRLSNHSKLVLKTTTIILLTGTLLSWLLEFGNFRTIANLSLPKQLMVSFFQTVTMRTAGFSTIDYTQTDFATNLVYIIQMLIGGAPGGTAGGFKVTVIAILLLLFKAELSGQSQVTFHYRTIPSSIIKQTLSILTFFFIILISGYLLLLELNPHIDPFSLFFEASSALATVGVTMNTTNQLTLGGRIVIMFLMFIGRVGPITVLLSILQKKEKEIHYAETEIILG

SEQ ID NO: 10083 - DNA, 561 bp, Streptococcus agalactiae
atgggattgttaggaggtttattccttgttttaactagtcctagaggagttattgctaataaattagtatttggagttttagataaagttgtttctgtttttagagctctgcccttcattattcttcttgctttgattgcgccagtaactcgcgtaattgtaggaacaacacttggttcaccagcagctttggtacctctttctttggcagttttcccattttttgctcgtcaagttcaagttgttttagctgaacttgatggtggagttattgaggctgcacaagcctcaggtggaacactttgggatattattgtagtttatcttcgtgaaggtctaccagatttaattcgagtatcaacggttactttgatttctttagtaggtgaaacagctatggctggcgctattggtgcaggaggattgggttctgttgctattactaaaggatataactattctcgtgatgatattactttagtagcgactattctgattttattattaattttctttatccaatttttaggtgattttttaacacgtcgcttgagtcataaa

SEQ ID NO: 10084 - protein, 187 aa, Streptococcus agalactiae
MGLLGGLFLVLTSPRGVIANKLVFGVLDKVVSVFRALPFIILLALIAPVTRVIVGTTLGSPAALVPLSLAVFPFFARQVQVVLAELDGGVIEAAQASGGTLWDIIVVYLREGLPDLIRVSTVTLISLVGETAMAGAIGAGGLGSVAITKGYNYSRDDITLVATILILLLIFFIQFLGDFLTRRLSHK

SEQ ID NO: 10085 - DNA, 714 bp, Streptococcus agalactiae
atgggacgtaagtgggccaatattgttgccaaaaagactgctaaagatggtgctaactcaaaagtatacgctaaattcggtgttgaaatatatgttgctgcaaagcaaggtgaaccagaccccgagtcaaactcagctctaaaattcgttttggaccgtgctaagcaagcacaagttccaaagcatgttattgataaagcgattgataaagccaaaggaaacacagatgaaactttcgtagagggacgctatgaaggttttggtccaaatggttcaatgattattgtggatactttgacatcaaatgttaaccgtacggcagcaaatgtacgtactgcttacggtaagaacggtggcaatatgggagcttcaggatcggtatcctacttatttgataaaaaaggtgtcatcgtttttgctggtgatgatgctgacactgtcttcgaacaattacttgaagcggatgtagacgtagatgatgttgaagcagaagagggaacaataacagtttataccgccccaacagatcttcataaaggtatccaagcacttcgcgataatggtgtagaagaattccaagttactgaacttgaaatgattcctcaatcagaagtagtattggaaggtgatgaccttgaaacttttgaaaagcttattgacgcactcgaatcagatgatgatgttcaaaaagtttatcataatgtagcagatttc

SEQ ID NO: 10086 - protein, 238 aa, Streptococcus agalactiae
MGRKWANIVAKKTAKDGANSKVYAKFGVEIYVAAKQGEPDPESNSALKFVLDRAKQAQVPKHVIDKAIDKAKGNTDETFVEGRYEGFGPNGSMIIVDTLTSNVNRTAANVRTAYGKNGGNMGASGSVSYLFDKKGVIVFAGDDADTVFEQLLEADVDVDDVEAEEGTITVYTAPTDLHKGIQALRDNGVEEFQVTELEMIPQSEVVLEGDDLETFEKLIDALESDDDVQKVYHNVADF

SEQ ID NO: 10087 - DNA, 519 bp, Streptococcus agalactiae
atgacttgtgcacttttactaattgatatccaacaaggtattatggataagaaaccaaagcatttaacaaattttgcagtgcttttagatgatttacttttaagtgccaaaggttctaattgtgaagtgatatggataaggcatcatgataaggaattgcctcaaggttctccacagtgggaaatttgggaacagcgacatcttgtgacgcatcacaaaataattgataaaacttacaatagttgttttaaagatactcatttacatgattacttgcaaagtaagcatattagtcaattaatcatgatgggacttcaaacagaatactgttttgatacatcagtaaaagttgcttttgaatatggttatgatatctttattccacaaggtggacacctaacatttgatacaccaactttaagtggggattctattaaaaaacattacgagaatatttggcatcatcgttttgcgacaatggtagcaaaagatagcttattgaaattaataaacgaggaa

SEQ ID NO: 10088 - protein, 173 aa, Streptococcus agalactiae
MTCALLLIDIQQGIMDKKPKHLTNFAVLLDDLLLSAKGSNCEVIWIRHHDKELPQGSPQWEIWEQRHLVTHHKIIDKTYNSCFKDTHLHDYLQSKHISQLIMMGLQTEYCFDTSVKVAFEYGYDIFIPQGGHLTFDTPTLSGDSIKKHYENIWHHRFATMVAKDSLLKLINEE

SEQ ID NO: 10089 - DNA, 630 bp, Streptococcus agalactiae
atggcactcgaattgctaacaccatttacaaaagttgaattagaagagaaaaagcgagatactaaccgaaaacaaattggaattatgggaggaaattttaaccctgttcataacgcccaccttgttgttgcagatcaagtacgtcagcaattgtgtttagaccaagttctgttgatgcctgaatttcagccaccacatattgataaaaaagagacaattgatgaacagcatcgtctcaagatgcttgaattagcaatagaaggcattgatggtttatctattgaaccaattgaaattgaacgtaaaggtatcagctatacatacgatacgatgaagcttctaattgaaaaaaatccagatgttgattattatttcattattggggcagatatggtggaatatctacctaagtggcatcgtattgatgaacttgttaaaatggtgcagtttgttggtgttcaacgtccaaaatataaagctggtacatcatatcccgttatttgggtggatctgccattgatggatatctcatcaagtatgattcgtcaatttattaaaagtaatcgtcagcccaactatttactgcctagagaggtattagattatatcaggaaagaaggtctttacaaa

SEQ ID NO: 10090 - protein, 210 aa, Streptococcus agalactiae
MALELLTPFTKVELEEKKRDTNRKQIGIMGGNFNPVHNAHLVVADQVRQQLCLDQVLLMPEFQPPHIDKKETIDEQHRLKMLELAIEGIDGLSIEPIEIERKGISYTYDTMKLLIEKNPDVDYYFIIGADMVEYLPKWHRIDELVKMVQFVGVQRPKYKAGTSYPVIWVDLPLMDISSSMIRQFIKSNRQPNYLLPREVLDYIRKEGLYK

SEQ ID NO: 10091 - DNA, 531 bp, Streptococcus agalactiae
atgaaattgagtatagatgattataggccgaccttcgtggttgaggcagtttatgatttaagagcagaagatttattacgtcatggcattcgtgcggttttagttgatttagataatacactcattgcttggaataatccagatggtactgctgaggtgcgtgcatggttagatgagatgacaacagcggatatttcagttgtagtagtgtctaataacaatcatgctcgcgtagaacgtgcagtatcacgttttggtgtggattttgtaagtcgtgcgatgaaaccatttactcgtggtataaacatggcaattgagcgttatggctttgatcgtgacgaggtgattatggttggagatcaattgatgacagatattcgtgctagtcatcgcgcaggaataaagtccgtattggtaaaaccaattgttaaatctgatgcttggaataccaagttcaatcgcttacgtgaacgtcgcgtttggaaaaaaatagaagagaattacggtaaaatcgtatatcaaaaaggaatt

SEQ ID NO: 10092 - protein, 177 aa, Streptococcus agalactiae
MKLSIDDYRPTFVVEAVYDLRAEDLLRHGIRAVLVDLDNTLIAWNNPDGTAEVRAWLDEMTTADISVVVVSNNNHARVERAVSRFGVDFVSRAMKPFTRGINMAIERYGFDRDEVIMVGDQLMTDIRASHRAGIKSVLVKPIVKSDAWNTKFNRLRERRVWKKIEENYGKIVYQKGI

SEQ ID NO: 10093 - DNA, 885 bp, Streptococcus agalactiae
atgaccttagctgccggactagcatggggcatttctggaattagtggtcaatacttgatgtcgcacggagtacacgttaaccttttgacttctttacgattgttgataacaggtatctttctcttgtctttagctagatcaaaacaaaaggagcatttagtagcagcgtggaaacagccaaaatttttaaagcaggttttacttttttctatatttggtttagttttaaatcaatatgcttttctcagagcgattcatttaacaaatgctggaactgcaacggttttgcaatatatggcaccaatacttattttgagtattgtttgtatcctaaacagacaaagaccaacatcttttgaaataatagcaattgctatggcaattttaggaacctatatgattgcaacgcatgggaagttaggaagtttagctatcacaccgaaaggattaatgtgggggcttggttccgccattacttattctatttatattttattacctgtgaaacttattcatgaatggggaagtacgattgttattggttcaggaatgtttataggtgggattttatttagtttggtgacaaaagcgtggcaataccccttacaaattaatgtgatgagtatacttgcttatattggcattattggtattgggactatttttgcttacacttttttccttaaaggggttagtattgtaggtgctgtcaagggtagcttattagcatcggtagagccagtttcttcggtatttttgacagtacttgttttaggagaaattttttatccaatagatttacttgggatgctgtttatttttcttgctgtaactctaatctcttacaaagatttaattgcattgaagaaaatgaaacgagtaaga

SEQ ID NO: 10094 - protein, 295 aa, Streptococcus agalactiae
MTLAAGLAWGISGISGQYLMSHGVHVNLLTSLRLLITGIFLLSLARSKQKEHLVAAWKQPKFLKQVLLFSIFGLVLNQYAFLRAIHLTNAGTATVLQYMAPILILSIVCILNRQRPTSFEIIAIAMAILGTYMIATHGKLGSLAITPKGLMWGLGSAITYSIYILLPVKLIHEWGSTIVIGSGMFIGGILFSLVTKAWQYPLQINVMSILAYIGIIGIGTIFAYTFFLKGVSIVGAVKGSLLASVEPVSSVFLTVLVLGEIFYPIDLLGMLFIFLAVTLISYKDLIALKKMKRVR

SEQ ID NO: 10095 - DNA, 1239 bp, Streptococcus agalactiae
atggatatccatcaaaacatgcattttgatcgtaaaaattatttctatccagataatcctaaagcttatcaaatttcacagtttgatgagcctattggttacaatggttggattgaaatcgaattagaagatggtacacgaaaaaaaattcgtattgagcgtgcccacctcgaagaagatgcaggaaaaaatacacatgggacagatggttattcctatgttgaccttaatagacaaggtgttccactgattgaaattgtatcagaagctgatatgcgttctcctgaggaagcttatgcttatttgacagctctcaaagagattatccaatatactggaatttctgacgttaaaatggaagaaggttctatgcgtgtagatgccaatatttcacttcgtccttatggtcaagaagagtttggtactaaagcagaacttaagaaccttaactcattcaataatgtacgtaaaggtttgatacatgaagaaaaacgtcaagcacaagttttacgatctggtggtcaaattcagcaagagactcgtcgttttgatgaaacaacaggtgagactattttgatgcgtgtcaaggaaggctcatcagattatcgctatttccctgaaccagatttaccactatttgatatctcggatgaatggattgatcaagttcgtttagaattaccagaatttccacaggaacgtcgtgcgaaatatgtatcgtcttttggtctatcatcttatgatgctagccaattaacagctacaaaagcaacttctgatttctttgaaaaagctgttgctattgggggtgatgcaaaacaagtttccaattggttacaaggagaagtggcgcaatttcttaacagtgaatcaaaatcaatcgaagaaattggtctgactcctgagaatttggttgagatgattggcttgattgctgacggtacaatttcatccaaaattgctaaaaaagtttttgtgcatttagctaaaaatggtggttcagctgaagaattcgttaaaaaggctggtttagttcaaatttcagatcctgaagtattaatcccaattattcatcaagtctttgcagataatgaagctgctgtgattgactttaagtcaggaaaacgcaatgctgataaggccttcacaggttatctaatgaaagcaacaaaaggacaagctaatccacaagttgctctgaagctgttagcgcaagaattagcaaaattaaaagaagaa

SEQ ID NO: 10096 - protein, 413 aa, Streptococcus agalactiae
MDIHQNMHFDRKNYFYPDNPKAYQISQFDEPIGYNGWIEIELEDGTRKKIRIERAHLEEDAGKNTHGTDGYSYVDLNRQGVPLIEIVSEADMRSPEEAYAYLTALKEIIQYTGISDVKMEEGSMRVDANISLRPYGQEEFGTKAELKNLNSFNNVRKGLIHEEKRQAQVLRSGGQIQQETRRFDETTGETILMRVKEGSSDYRYFPEPDLPLFDISDEWIDQVRLELPEFPQERRAKYVSSFGLSSYDASQLTATKATSDFFEKAVAIGGDAKQVSNWLQGEVAQFLNSESKSIEEIGLTPENLVEMIGLIADGTISSKIAKKVFVHLAKNGGSAEEFVKKAGLVQISDPEVLIPIIHQVFADNEAAVIDFKSGKRNADKAFTGYLMKATKGQANPQVALKLLAQELAKLKEE

SEQ ID NO: 10097 - DNA, 495 bp, Streptococcus agalactiae
atgctaggtatcatagatgcaaaacctaaggttggttatttttatttaggacagtatcatgcttcaatagggacaagtcattttgaaaagatgacagtttcagaaattatggggatccctctgacagttcatcaaaaagattcagtttatgatgttattgtacatatttttatggaagatgctggttgtgcttttatcttggatgatgatgattttctctgtggagtcgtgtcacgtaaagatttactaaaaatcagtattggcggaggagatctttctaaaatgccaataggaatggtgatgacacgtatgccacacgtgacaactgttttagaaaatgaaagtctttttgcggcagctgataaattagtgagcagaaaagtggatagtctccctgtcgttcgtcatgataagcaatatcccgaaaaatttaaagtgatcgggaaattatctaaaacaatcctcgctagtttgtttttagaaataagagattat

SEQ ID NO: 10098 - protein, 165 aa, Streptococcus agalactiae
MLGIIDAKPKVGYFYLGQYHASIGTSHFEKMTVSEIMGIPLTVHQKDSVYDVIVHIFMEDAGCAFILDDDDFLCGVVSRKDLLKISIGGGDLSKMPIGMVMTRMPHVTTVLENESLFAAADKLVSRKVDSLPVVRHDKQYPEKFKVIGKLSKTILASLFLEIRDY

SEQ ID NO: 10099 - DNA, 783 bp, Streptococcus agalactiae
atgccgaatttattagaaaaaactagaaaaattacatccatcttacagcgttccgtagatagcttagatgccgaactaccatataatacaatggcggctcaattagctgatattattgactgtaacgcatgtattattaatggtggtggtaacttacttggctatgccatgaaatataaaacaaacactgaccgtgtggaagaattttttgaaacaaaacaattcccagattactatgttaaatctgctagtcgtgtttatgatacagaagctaacttatcagtagataatgatttgtcaattttcccagttgagacaaaggaaaacttccaagatggtattacaacaatcgctccaatttatggtggtggaatgcgcttgggaacatttattatctggcgtaatgataaagaatttagcgacgatgatttgattttagttgaaattgcaagcaccgttgttggtattcaattacttaaccttcaaacagaaaatctagaagaaaatattcgtaaacaaacagcggtgacaatggctatcaacactctatcttattcagaaatgaaagctgtagctgctatcttaggagaattagatggacttgaaggacgcctaacggcatctgttattgcagaccgtattggaattacacgttccgttattgtaaatgctcttcgtaaattggagtctgcgggaatcattgagagccgctcactcggtatgaagggaacatacctcaaagttattaacgaaggtatttttgacaaattaaaagaatataat

SEQ ID NO: 10100 - protein, 261 aa, Streptococcus agalactiae
MPNLLEKTRKITSILQRSVDSLDAELPYNTMAAQLADIIDCNACIINGGGNLLGYAMKYKTNTDRVEEFFETKQFPDYYVKSASRVYDTEANLSVDNDLSIFPVETKENFQDGITTIAPIYGGGMRLGTFIIWRNDKEFSDDDLILVEIASTVVGIQLLNLQTENLEENIRKQTAVTMAINTLSYSEMKAVAAILGELDGLEGRLTASVIADRIGITRSVIVNALRKLESAGIIESRSLGMKGTYLKVINEGIFDKLKEYN

SEQ ID NO: 10101 - DNA, 411 bp, Streptococcus agalactiae
atgtcacaaaaatatgaacgcatccttgtcgctattgatggatcaacagaatctgaacttgcttttgaaaaggcagttaacgttgctcttcgcaatgattctgaattaatcttgacacatgttatagatacacgtgctttacaaagctttgcgacatttgatacttatatctatgaaaaattagaaaaagaagcaaaagatgtccttgaggaatatgaaaaacaagctcgtgaaaaaggagcagataaagttagacaagtcattgaatttggtaatcccaaaacattacttgcacatgatattccagaaaaagaaaaagtagacttgattatggttggtgcaacaggtcttaatacctttgaacgtttcctatcggatcttcctcagaatacatccttcgtcacgctaaag

SEQ ID NO: 10102 - protein, 137 aa, Streptococcus agalactiae
MSQKYERILVAIDGSTESELAFEKAVNVALRNDSELILTHVIDTRALQSFATFDTYIYEKLEKEAKDVLEEYEKQAREKGADKVRQVIEFGNPKTLLAHDIPEKEKVDLIMVGATGLNTFERFLSDLPQNTSFVTLK

SEQ ID NO: 10103 - DNA, 891 bp, Streptococcus agalactiae
atgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggt

SEQ ID NO: 10104 - protein, 297 aa, Streptococcus agalactiae
MSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 10105 - DNA, 912 bp, Streptococcus agalactiae
atgttacaaaacattggacaaacaggcattcaagcaactcgaattgctttaggttgtatgagaatgagtgacttgaaaggaaaacaagctgaagaagtagttggaacagcattagatttgggtattaatttttttgatcatgctgatatttatgggggagggctatctgaattacgctttcgagatgcaatcaaacatttaaatgtcaatcgtgacaaaatgattattcaatctaaatgtgggatacgagaaggttactttgatttttctaaagagtatattttatcatcagtagatggtattttagaaagattagggacagaatatttagattttctcattcttcatcgtccagatgtattagttgagcctgaagaagtagcagaagcatttaccaaactgagggcagaaggtaaagtaaaacactttggtgttagcaatcaaaaccggtttcaaatggagttgttacaatcctaccttgacgagcccttagcagtgaatcaacttcagttatcgccagcacatacaccaatgtttgatgcagggttaaatgttaacatgttaaataaagcttcaattgaacatgatgatggcattgttgattattgtcgtcttaaaagagttaccattcaagcttggtctccatttcaaattgatttatctcgtggtttatttgttaatcatccggattataaggaattaaatgaaaccatagctaaactggcaaaaaactacaatgttagcagcgaagctattgtgattgcatggattttacgtcatcctgccaaaatgcaggcgattgttggttcaatgaatccatctcgtttaaaggcgattgataaggctaatgatatcgctttaacccgtaaagaatggtatgatatttaccgtagtgcaggtaatatattgcct

SEQ ID NO: 10106 - protein, 304 aa, Streptococcus agalactiae
MLQNIGQTGIQATRIALGCMRMSDLKGKQAEEVVGTALDLGINFFDHADIYGGGLSELRFRDAIKHLNVNRDKMIIQSKCGIREGYFDFSKEYILSSVDGILERLGTEYLDFLILHRPDVLVEPEEVAEAFTKLRAEGKVKHFGVSNQNRFQMELLQSYLDEPLAVNQLQLSPAHTPMFDAGLNVNMLNKASIEHDDGIVDYCRLKRVTIQAWSPFQIDLSRGLFVNHPDYKELNETIAKLAKNYNVSSEAIVIAWILRHPAKMQAIVGSMNPSRLKAIDKANDIALTRKEWYDIYRSAGNILP

SEQ ID NO: 10107 - DNA, 2526 bp, Streptococcus agalactiae
atggcaaatattctacgcactgttattgaaaatgacaagggtgaattaaaaaaattagataaaatagctaagaaagttgactcttacgcagatcatatggctgcgttatcagatgaagctttacaagcaaaaactccagaatttaaagaacgttatcaaaatggtgaaactttagatcaattgttaccggaagcgtttgcggtagttcgtgaagcttctaaacgtgtattaggtttatacccataccacgtccaaattatgggtggtatcgttcttcaccatggtgatattccagaaatgcgtactggtgagggaaaaactttaacagcgacaatgcctgtttatctaaatgctatctcaggattaggtgttcatgttattactgttaatgagtatttatcaacacgtgatgcgaccgaaatgggtgaggtttatagttggcttggattatctgtagggattaacttagcagctaagtcaccatttgaaaaacgcgaagcttacaattgtgatatcacatactcaactaacgcagaagtcggatttgactaccttcgagacaatatggttgttcgccaagaagatatggtgcaacgcccactcaactatgctttggttgatgaggttgactctgtattaatcgatgaagctaggacgccattgattgtttcaggtcctgtaagctctgagatgaaccaactgtatacacgtgcggacatgtttgtaaaaacgcttaatagcgatgattatatcattgatgttccaacaaaaacaattggtttatcagatacaggtattgacaaggctgaaaactatttccatctaaataacttgtatgatctcgaaaatgttgccttaactcactacattgataacgctcttcgagctaactatattatgttgttaaatattgattatgtggttagtgaagaacaagagattttaattgtggaccaatttaccggtcgtacgatggaaggacgtcgtttctcagatggcttacaccaagctattgaagcaaaagagtcagtgccaatccaagaagaatcaaaaacgagcgcttcaattacttaccaaaatatgttccgtatgtaccataaattagcaggaatgactggtactggtaagactgaggaagaagagtttcgtgaaatttataatatgcgcgttattcctatcccaacaaatcgtcctgttcaacgtatagatcattcagatctactttatccaactcttgactctaaatttagagcggtggtagcagatgtcaaagaacgttatgaacaaggacaacctgtactggttggtacagtagctgttgaaacgtcagacttaatttctagaaaattagttgctgctggagtaccacatgaagttttgaatgctaaaaatcactttaaagaagctcaaatcattatgaatgctgggcaacgtggtgctgttacaatcgcaaccaacatggctggtcgtggtactgatatcaagcttggtgaaggggttcgtgaacttggtggtttatgtgttattggtacagagcgtcatgaaagccgtcgtattgataaccagcttcgtggtcgttcgggtcgtcaaggagatccaggtgaatcacaattctatctttcgttagaagatgatttgatgcgtcgctttggtacagatcgtattaaagtggttcttgagcgaatgaatttagctgaagatgatacagttattaaatcaaaaatgttgacacgacaagttgaatcagctcaacgccgcgttgaaggtaataactatgacacacgtaaacaagtcttgcaatacgatgatgttatgcgtgaacaacgtgagattatttatgctaaccgtagagaagtgattactgctgagcgtgatttaggaccagagctcaaagggatgattaaacgtacgattaaaagagcagttgatgcacatagcagaagcgataaaaatactgcagcagaagctattgttaattttgcaagatcggcgttattagatgaagaagctatcacagtttcagaacttcgtggtctaaaagaggctgaaattaaagaacttctttatgaacgtgccttagctgtttatgagcaacaaattgctaaattaaaagatccagaagctattatcgaattccaaaaagtcttaatcttgatggtagtggataatcaatggacagagcatattgatgccttagatcaattacgtaactccgttggacttcgtggttatgctcaaaataacccaatcgttgagtatcaatcagaaggtttccgtatgttccaagatatgattggttcgattgagtttgatgtgacacgtacattgatgaaagctcaaattcatgaacaagagcgtgaacgtgcttctcaacatgctacgacaacagcagagcaaaatatctcggcacaacatgtacctatgaataatgaatcaccagaataccaagggattaaacgtaatgataaatgtccttgtggctctggcatgaagtttaaaaattgtcatggtctgagatgtttacaa

SEQ ID NO: 10108 - protein, 842 aa, Streptococcus agalactiae
MANILRTVIENDKGELKKLDKIAKKVDSYADHMAALSDEALQAKTPEFKERYQNGETLDQLLPEAFAVVREASKRVLGLYPYHVQIMGGIVLHHGDIPEMRTGEGKTLTATMPVYLNAISGLGVHVITVNEYLSTRDATEMGEVYSWLGLSVGINLAAKSPFEKREAYNCDITYSTNAEVGFDYLRDNMVVRQEDMVQRPLNYALVDEVDSVLIDEARTPLIVSGPVSSEMNQLYTRADMFVKTLNSDDYIIDVPTKTIGLSDTGIDKAENYFHLNNLYDLENVALTHYIDNALRANYIMLLNIDYVVSEEQEILIVDQFTGRTMEGRRFSDGLHQAIEAKESVPIQEESKTSASITYQNMFRMYHKLAGMTGTGKTEEEEFREIYNMRVIPIPTNRPVQRIDHSDLLYPTLDSKFRAVVADVKERYEQGQPVLVGTVAVETSDLISRKLVAAGVPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGTDRIKVVLERMNLAEDDTVIKSKMLTRQVESAQRRVEGNNYDTRKQVLQYDDVMREQREIIYANRREVITAERDLGPELKGMIKRTIKRAVDAHSRSDKNTAAEAIVNFARSALLDEEAITVSELRGLKEAEIKELLYERALAVYEQQIAKLKDPEAIIEFQKVLILMVVDNQWTEHIDALDQLRNSVGLRGYAQNNPIVEYQSEGFRMFQDMIGSIEFDVTRTLMKAQIHEQERERASQHATTTAEQNISAQHVPMNNESPEYQGIKRNDKCPCGSGMKFKNCHGLRCLQ

SEQ ID NO: 10109 - DNA, 714 bp, Streptococcus agalactiae
atgattattttgattattgcactggcaactattttgacatttgtcacatggatgttgattcgtccaaaagctctacggtatattctaggtcttctctcattagctttgttgtttgcctcagtttggatgttaacggatcactttattaatcatacaggtatgactattgaaactaagacaaagacacgtgagatttatagtgcgggtgatagtaaggctccatttggtctcatgatttataaagagattggtactcattcgagtaataatgttttagtttatcgaacagatttaaatcaaaaagaagcaaaagctcactttgttccaaatacaaaagaagtgacaagtgctgtgaaaaaatctgctagctaccaattagctgatgtgaaaaaagccacagtaacaacaaagactaaacgttatgtgtggaaagatagtctttcgaaactactttatggctttgcaggtgaaaatggagaattgatttctcagaaatcagttgctaaaataccacgaaaaacttggctagttttgactaaagagcagtccgaacacttagaatcggctgcggctaaactaaaagaacaaatgacttcgcaagcaaaagtaaacccagtgaaagctatggagataaagacattagctaagacaaatccagaagcttatgctgagatgcaagttaaagcattaaaagaagctcttaatataaaagaa

SEQ ID NO: 10110 - protein, 238 aa, Streptococcus agalactiae
MIILIIALATILTFVTWMLIRPKALRYILGLLSLALLFASVWMLTDHFINHTGMTIETKTKTREIYSAGDSKAPFGLMIYKEIGTHSSNNVLVYRTDLNQKEAKAHFVPNTKEVTSAVKKSASYQLADVKKATVTTKTKRYVWKDSLSKLLYGFAGENGELISQKSVAKIPRKTWLVLTKEQSEHLESAAAKLKEQMTSQAKVNPVKAMEIKTLAKTNPEAYAEMQVKALKEALNIKE

SEQ ID NO: 10111 - DNA, 2811 bp, Streptococcus agalactiae
atgataagaggagcaagagctcacaatttaaaaaatataagtgtcgacattccacgagacaagttagttgtcgttacgggactatcaggatcaggtaagtctagtttggcctttgacactatctatgcagaaggacaacgtcgttacgttgaaagtctttctgcttacgcgcgccaatttttgggaaatatggaaaagcctgatgtagattctattgatggccttagtccagctatttctattgatcagaaaacaacaagtaagaatcctcgctctactgttgggactgtaacagaaattaacgattatttacgtttgctttatgctcgtgttggaaccccatattgtatcaatggtcacggagccatcacagcatcttctgtagagcaaattgtggataaggtactagcgcttccagagcgaacaaagatgcaaattttagccccaattatacgtcgaaaaaaaggacaacacaaatcaacatttgagaaaatacaaaaagatggttacgttcgtgttcgtattgatggtgatattcacgatgttactgaggtgcctgaattatcaaaaagtaagatgcacaatattgatattgtagtagatcgattaattaataaagagggcattcgttcccgcttatttgattccgttgaagcggctctacgtttgtcggatggttatgtcgttattgatacaatggatggcaatgagttattgttttcagaacattattcttgtcctgaatgtggttttactgttcctgaattagagccacgccttttttcttttaatgctccctttggttcttgtccgacctgtgatggcttaggaattaagttagaagtagatatagatttggttattccagatagaagtaagacccttagagaaggggccttagttccttggaatccaatttcatcaaattattatccaacgatgctagagcaagctatgactcaatttggtgttgatatggatacgccatttgaaaaattaagcaaggcggagcaggacctagccctatatggttcaggcgaacgagagttccatttccattatattaacgattttggaggcgagagaaatattgatttgccttttgaaggggttgtcaataatattaatcgtcgttaccatgaaactaatagcgattacacacgcaatgttatgcgagaatatatgaacgagctaaaatgtaacacttgtcatggctatcgtctcaatgatcaagcactttgcgtaagagttgggggagaagaaggtcttaatattgggcaagtctcagatttatcgatagcagaccatttagaacttttagaaacattgcgtttatcttcaaatgaacaattaattgctcgaccaattatcaaagaaatccatgaccgtctaagtttcttaaataatgttggacttaattatttaaatctgtcacgttctgcaggaacactttccgggggcgagagtcaacgtattcgtttggctactcaaattgggtctaatttatcaggtgtcctttatgtacttgatgagccgtccattggacttcatcagcgagacaatgaccgtttgattgatagtcttaagaaaatgcgtgatttgggtaatacgcttattgttgttgaacatgatgaagatacaatgatggcagctgattggttaatcgatgtgggacctggcgctggtgcgtttggtggtgagattgtggcctctggtacaccgaagcaagtagctaaaaatactaaatctattacaggacaatatttgtcaggtaagaaagtgattcctgtgccatctgaacgaagagtaggtaatggtcgctttttagaaatcaaaggtgcggcagaaaacaacctacaaaatttagatgtcaagttccctctcggtaaatttattgccgtaactggtgtctcaggttctggaaaatcaaccttaattaatagtattttgaaaaaagctgttgcgcagaagcttaaccgtaactcagataaaccaggtaaatatgtttctttagaaggcattgaatatgttgatcgattgattgatattgatcaaagtccaattggtcggactccacgttctaatcccgcaacctatacaggtgtttttgatgatattcgtgatctttttgctcaaactaatgaggcaaagattcgaggttataaaaaaggacgcttctcatttaacgtcaaaggtggacgttgtgagtcttgttctggcgatggtatcatcaaaattgagatgcattttttaccagatgtctacgttccttgtgaagtatgccacggcacgcgctataatagtgagactctggaagtacattacaaagaaaaaaatattgcacaaattcttgatatgacagtgaatgatgcagttacattttttgcagctattcctaaaattgctcgtaagttacagactattaaggatgttggtttgggatatgtcactttggggcaaccagctacaaccttatcaggaggagaagctcagcgaatgaagctggcaagtgaattacataagcgttcgacaggtaagagtctttacatattagacgaaccaacaacggggcttcatgcagatgatattgctcgtttacttaaggttttggatcgttttgtagatgatggtaatacagtgcttgttattgagcataaccttgatgttattaaaactgctgaccacattattgatcttggccctgaaggaggtattggtggcggacaaattgtagctatcggaacaccagaagaagttgctgaaaatcctaaatcctatacaggatattatttaaaagagaagttagcaaga

SEQ ID NO: 10112 - protein, 937 aa, Streptococcus agalactiae
MIRGARAHNLKNISVDIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSVEQIVDKVLALPERTKMQILAPIIRRKKGQHKSTFEKIQKDGYVRVRIDGDIHDVTEVPELSKSKMHNIDIVVDRLINKEGIRSRLFDSVEAALRLSDGYVVIDTMDGNELLFSEHYSCPECGFTVPELEPRLFSFNAPFGSCPTCDGLGIKLEVDIDLVIPDRSKTLREGALVPWNPISSNYYPTMLEQAMTQFGVDMDTPFEKLSKAEQDLALYGSGEREFHFHYINDFGGERNIDLPFEGVVNNINRRYHETNSDYTRNVMREYMNELKCNTCHGYRLNDQALCVRVGGEEGLNIGQVSDLSIADHLELLETLRLSSNEQLIARPIIKEIHDRLSFLNNVGLNYLNLSRSAGTLSGGESQRIRLATQIGSNLSGVLYVLDEPSIGLHQRDNDRLIDSLKKMRDLGNTLIVVEHDEDTMMAADWLIDVGPGAGAFGGEIVASGTPKQVAKNTKSITGQYLSGKKVIPVPSERRVGNGRFLEIKGAAENNLQNLDVKFPLGKFIAVTGVSGSGKSTLINSILKKAVAQKLNRNSDKPGKYVSLEGIEYVDRLIDIDQSPIGRTPRSNPATYTGVFDDIRDLFAQTNEAKIRGYKKGRFSFNVKGGRCESCSGDGIIKIEMHFLPDVYVPCEVCHGTRYNSETLEVHYKEKNIAQILDMTVNDAVTFFAAIPKIARKLQTIKDVGLGYVTLGQPATTLSGGEAQRMKLASELHKRSTGKSLYILDEPTTGLHADDIARLLKVLDRFVDDGNTVLVIEHNLDVIKTADHIIDLGPEGGIGGGQIVAIGTPEEVAENPKSYTGYYLKEKLAR

SEQ ID NO: 10113 - DNA, 942 bp, Streptococcus agalactiae
atgaagcaaatgtttctttcaacggcaattgaatttaaagaaattgaaacattcgagccaggtgcttggataaatctggttaatccctcccaggaagaatccgaacaagtagctgatcaatttggtattgatattgatgatttacgtgctcccctcgatgtggaagaaacttcccgtatctcggttgaagatgattatactttagttattgttgacgttcctacctatgaagaacgcaataacaaaagttattatatgactattcctatgggcattatcgttactgacaacgctgttattactacttgcctagaacatttgacgctgtttgatcacttttatagacgacgtgtcaaaaatttttatacctttatgaagacacgttttgttttccaattgctttatcgcaatgccgaattatacttacaggctttgcgtactatcgataggcagagcgataaaattgaagcacaactagagagtgcaactcgaaatgagcaattgatcgatatgatggaattggaaaaatctattgtctatctaaaggcctctttaaaatttaatgagcgaatcgtcaaaaaattgaccagtagtaccagtagtttaaaaaaatacattgaagatgaagatctgcttgaagatacattgatcgaaactcagcaggctattgaaatggcaaatatctatgaaaatgtcttaaatgccatgacagaaacgactgcttcaatcatcggtaataatcagaataccattatgaaaaccttagccctagtaactatgacattggatattccaacggttattttttcggcgtatgggatgaactttcaaaataattggatgcctttgaatggtctcgcacatggctttatctatgttgttcttttggcctttttgatgagttcatttgttgtattttattttattcgtaaaaaatggttt

SEQ ID NO: 10114 - protein, 314 aa, Streptococcus agalactiae
MKQMFLSTAIEFKEIETFEPGAWINLVNPSQEESEQVADQFGIDIDDLRAPLDVEETSRISVEDDYTLVIVDVPTYEERNNKSYYMTIPMGIIVTDNAVITTCLEHLTLFDHFYRRRVKNFYTFMKTRFVFQLLYRNAELYLQALRTIDRQSDKIEAQLESATRNEQLIDMMELEKSIVYLKASLKFNERIVKKLTSSTSSLKKYIEDEDLLEDTLIETQQAIEMANIYENVLNAMTETTASIIGNNQNTIMKTLALVTMTLDIPTVIFSAYGMNFQNNWMPLNGLAHGFIYVVLLAFLMSSFVVFYFIRKKWF

SEQ ID NO: 10115 - DNA, 312 bp, Streptococcus agalactiae
atggcattagaagtaacagatgctacatttgtagaagaaactaaagaaggtttagtactcattgatttttgggcaacttggtgtggtccatgtcgtatgcaagcaccaatcttagaacagttatctcaagaaatcgatgaagatgaactcaaaattttgaaaatggatgttgatgagaatccggaaactgcccgtcagtttggtattatgtcaattccaacattgatgtttaaaaaagacggagaagtggttaaacaagttgcaggtgttcatactaaagaccaactgaaagctattattgctgaattgagt

SEQ ID NO: 10116 - protein, 104 aa, Streptococcus agalactiae
MALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 10117 - DNA, 2346 bp, Streptococcus agalactiae
atgaagagtatgaataacaagattttagaacagttagaatttaacaaagttaaggaattgatattaccttatctcaagacagaacaatcacaagaagaattatcagagctggagccgatgacggaggctcctaaaatagaaaaaagttttaatgaaatttctgacatggaacagatttttgttgaacatcactcatttggcatagtcagcctaagttcaatctctgagagtttaaaacgcttagagctttcagctgatcttaatattcaagaacttttggctatcaaaaaagttttacagagttcttcggatatgattcacttttattctgatttggataatgtttctttccaatctttggatcgtttgtttgaaaatttggaacaattccctaatctgcaagggtcttttcaagctatcaatgatggtggttttttagaacattttgcgagtccagaattagagcgtatccgtcgtcaattaacaaacagtgaacgacgggttcgtcagattttacaggatatgcttaaggaaaaagcagagcttttatcagagaatctaatcgctagtcgtagtggacgaagtgtcctaccagtaaaaaatacttatcggaatcgtatttctggtgtggttcatgacatctcttcttcaggaagtactgtttatattgagcctcgtgctgtagttacactaaacgaagagataacgcagcttagagctgacgaacgtcatgaagaaagtcgtattttacacgcattttcagacttgttaagaccccatgtcgccactattagaaataatgcatggattcttgggcatcttgattttgtaagggctaaatatctttttatgtctgataataaggcgacgatacctgagatttctaatgacagcacgttagcattaatcaatgttcgtcatcctctgttaagtaaccctgtggctaatgacttacattttgatcaagatttaactgcaattgtcatcactggtcccaatactggtggtaagacgattatgctaaaaacactcggtttagcacaattaatgggacagtctggtttgccagtattagcggataaaggtagtaaaattgcagtatttaacaatatctttgcagatattggcgatgagcaatctattgaacaaagtctatcaactttttctagtcatatgacgcacatagtcagtattttaaacgaggctgaccacaatagtttagtcctctttgatgaactgggagcaggaacggatcctcaagaaggtgctagtttggctatggctattttagaacaccttaggttaagtaatatcaaaacgatggcgaccacgcactatccagaattaaaagcttatgggattgagacaaattttgtagagaatgcgagcatggaatttgatgccgaaacgcttagccctacgtatcgctttatgcaaggagttcctggacgatcaaatgcatttgaaattgcttctcgccttggtttagctccatttattgttaaacaagctaagcagatgacagattctgactcagatgttaaccgtattattgaacagttagaggcacagacacttgagacacgtagaagactggatcatattaaagaagttgaacaagaaaacctcaaattcaatcgtgcggttaagaaactctataatgaattttcacatgagcgcgataaagagttagaaaaaatctatcaagaagctcaagaaattgtagatatggctttgaatgagagtgatactatcttaaaaaaactcaatgataagagccaattaaaacctcacgaaattatagatgctaaggcacaaataaaaaaattagcacctcaagttgatttatcaaaaaataaagtcttaaataaggctaaaaaaattaaagcagctcgtgctcctagaattggtgatgatattatagtgactagctatggacagcgaggtaccttaactagtcaattaaaagatggacgttgggaagcacaagtgggaattatcaaaatgacattaacacaagatgaatttacccttgttagagtccaagaagaacagaaagtcaaaagtaaacagattaatgtggttaaaaaggctgatagttctggaccaagagctcgacttgatcttagaggtaaaagatacgaagaagctatgcaagagttagataattttattgatcaagcattgcttaacaatatgggacaagttgatatcattcatggtattggtacaggcgttatccgtgagggagtgacaaaatatcttcgtcgtaataagcacgttaagcattttgcttatgccccacaaaatgcagggggatctggcgccacaattgtaacgttaggg

SEQ ID NO: 10118 - protein, 782 aa, Streptococcus agalactiae
MKSMNNKILEQLEFNKVKELILPYLKTEQSQEELSELEPMTEAPKIEKSFNEISDMEQIFVEHHSFGIVSLSSISESLKRLELSADLNIQELLAIKKVLQSSSDMIHFYSDLDNVSFQSLDRLFENLEQFPNLQGSFQAINDGGFLEHFASPELERIRRQLTNSERRVRQILQDMLKEKAELLSENLIASRSGRSVLPVKNTYRNRISGVVHDISSSGSTVYIEPRAVVTLNEEITQLRADERHEESRILHAFSDLLRPHVATIRNNAWILGHLDFVRAKYLFMSDNKATIPEISNDSTLALINVRHPLLSNPVANDLHFDQDLTAIVITGPNTGGKTIMLKTLGLAQLMGQSGLPVLADKGSKIAVFNNIFADIGDEQSIEQSLSTFSSHMTHIVSILNEADHNSLVLFDELGAGTDPQEGASLAMAILEHLRLSNIKTMATTHYPELKAYGIETNFVENASMEFDAETLSPTYRFMQGVPGRSNAFEIASRLGLAPFIVKQAKQMTDSDSDVNRIIEQLEAQTLETRRRLDHIKEVEQENLKFNRAVKKLYNEFSHERDKELEKIYQEAQEIVDMALNESDTILKKLNDKSQLKPHEIIDAKAQIKKLAPQVDLSKNKVLNKAKKIKAARAPRIGDDIIVTSYGQRGTLTSQLKDGRWEAQVGIIKMTLTQDEFTLVRVQEEQKVKSKQINVVKKADSSGPRARLDLRGKRYEEAMQELDNFIDQALLNNMGQVDIIHGIGTGVIREGVTKYLRRNKHVKHFAYAPQNAGGSGATIVTLG

SEQ ID NO: 10119 - DNA, 858 bp, Streptococcus agalactiae
ttgcaagaaaagataagaaccgatttagctcaacatcatataagtaataacaatccttatgtggtattttcagctaaaatatcaggagctactgttcttttatatacttctggaaaacttgtcttccagggttctaacgcttcacatatcgcccaaaagtatggttttattgagcaaaaagaaagttgttcctctgagagtcaagatattcccataattggtactgatgaagtgggaaatggctcttactttggtggactggcagtggtagctagttttgtaactcctaaggaccatgcttacctcaaaaaattaggtgttggtgattcaaaaacacttactgatcaaaaaattaagcaaatcgcgcctcttttggaaaaagcaattccacacaaagcattattgttatcgcctcaaaaatataatcaagtggttagtccaaataacaaacataatgctgtctccgtaaaagttgctttacacaatcaagctatcttccttcttcttcaagatggttttgaaccagaaaaaatcgttattgatgcttttactagctccaaaaactatcaaaattatttgaaaaatgaaaagaatcaatttaaacaaacgattactctggaagaaaaagctgaaaataaatatctagctgtagcggtcagttctattattgcacgtaatctattcttagaaaaccttaacaaattaagcgacgacgtaggatataaacttccaagtggagctggtcaccaatctgataaggtcgctagccaattactcaaagcttatggtatctcttcgcttgaacactgcgcaaaacttcattttgccaacaccaaaaaagcacaagcattattaaaa

SEQ ID NO: 10120 - protein, 286 aa, Streptococcus agalactiae
MQEKIRTDLAQHHISNNNPYVVFSAKISGATVLLYTSGKLVFQGSNASHIAQKYGFIEQKESCSSESQDIPIIGTDEVGNGSYFGGLAVVASFVTPKDHAYLKKLGVGDSKTLTDQKIKQIAPLLEKAIPHKALLLSPQKYNQVVSPNNKHNAVSVKVALHNQAIFLLLQDGFEPEKIVIDAFTSSKNYQNYLKNEKNQFKQTITLEEKAENKYLAVAVSSIIARNLFLENLNKLSDDVGYKLPSGAGHQSDKVASQLLKAYGISSLEHCAKLHFANTKKAQALLK

SEQ ID NO: 10121 - DNA, 1092 bp, Streptococcus agalactiae
atgttaatttttcctttaataaatgatacgtcgcgtaaaattatccacattgatatggatgctttttttgcatctgtggaagagcgtgacaatccctctcttaaaggaaagcctgttattattggttctgatcccagaaaaaccggcggcagaggggttgtttctacttgtaattatgaggctcgaaagtttggagttcattcagctatgtcttcaaaagaagcgtatgaacgatgccctcaagctatctttatttcgggaaattaccaaaaatatcgccaagtaggaatggaagtacgagatatatttaaaaagtatacggatttggttgaaccgatgagtatagacgaagcttatttagatgtaactgaaaataaaatgggaataaaatcagctgttaaacttgctaaaatgatacaatacgatatttggaatgatgtccatttgacctgttcagcgggtatttcctacaataaatttttggcaaaattggcttctgactttgagaaaccaaaaggacttaccctcatcctaccagatcaagctcaagatttcttgaagcccttaccaatagagaaatttcatggtgttggtaaacgctccgtcgaaaaattacatgctttaggggtttatactggtgaggacctcctttccttatctgaaatttctttaattgatatgtttggtcgtttcgggtatgacctttatcgtaaggcaagagggattaatgcttccccggtaaaacctgatagagttcgtaaatcaataggaagtgagaaaacctatgggaaattactatataacgaagcagatatcaaagctgagatttcaaagaacgttcagagagttgttgcttctctggagaaaaataagaaagttggtaagacaatcgttttaaaagttagatatgcggattttgaaacattgacgaaacgtatgacattagaagagtatactcaagattttcaaatcattgatcaagttgctaaagcgatatttgataccttagaagagtcagtttttggcatacgactcttaggtgttacagtaacgaccctggaaaatgaacatgaagctatctatttagatttt

SEQ ID NO: 10122 - protein, 364 aa, Streptococcus agalactiae
MLIFPLINDTSRKIIHIDMDAFFASVEERDNPSLKGKPVIIGSDPRKTGGRGVVSTCNYEARKFGVHSAMSSKEAYERCPQAIFISGNYQKYRQVGMEVRDIFKKYTDLVEPMSIDEAYLDVTENKMGIKSAVKLAKMIQYDIWNDVHLTCSAGISYNKFLAKLASDFEKPKGLTLILPDQAQDFLKPLPIEKFHGVGKRSVEKLHALGVYTGEDLLSLSEISLIDMFGRFGYDLYRKARGINASPVKPDRVRKSIGSEKTYGKLLYNEADIKAEISKNVQRVVASLEKNKKVGKTIVLKVRYADFETLTKRMTLEEYTQDFQIIDQVAKAIFDTLEESVFGIRLLGVTVTTLENEHEAIYLDF

SEQ ID NO: 10123 - DNA, 2310 bp, Streptococcus agalactiae
atggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagataacgagcttatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagatcaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggtgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttgacacaacgtgtcttccatgaagtactttcaatggacgatgcattaactaac

SEQ ID NO: 10124 - protein, 770 aa, Streptococcus agalactiae
MATVKTNTDIFEQAWEGFKGVDWKEKASIARFVQANYAPYDGDESFLAGATERSLHIKKVIEETKAHYEETRFPMDTRVASISELPAGFIDKDNELIFGIQNDELFKLNFMPKGGIRMAETTLKENGYEPDPAVHEIFTKYATTVNDGIFRAYTSNIRRARHAHTVTGLPDAYSRGRIIGVYARLAVYGADYLMQEKVNDWNALNDIDEESIRLREEINLQYQALGEVVKLGDLYGVDVRKPAMNTKEAIQWVNIAFMAVCRVINGAATSLGRVPIVLDIFAERDLARGTFTESEIQEFVDDFVLKLRTVKFARTKAYDALYSGDPTFITTSMAGMGADGRHRVTKMDYRFLNTLDNIGNSPEPNLTVLWSDQLPYAFRRYCMSMSHKHSSIQYEGVSTMAKEGYGEMSCISCCVSPLDPENEDKRHNLQYFGARVNVMKALLTGLNGGYDDVHKDYKVFDIDPIRDEVLNFDTVKANFEKSLDWLTDTYVDAMNIIHYMTDKYNYEAVQMAFLPSHVRANMGFGICGFANTVDSLSAIKYATVKPIRDEDGYIYDYETVGDFPRYGEDDDRVDSIAEWLLEAFHGRLAKHKLYKDAEATVSLLTITSNVAYSKQTGNSPVHKGVYLNEDGSVNLSKVEFFSPGANPSNKAKGGWLQNLNSLSKLDFAHANDGISLTTQVSPRALGKTFDEQVDNLVTVLDGYFENGGQHVNLNVMDLKDVYDKIMNGEDVIVRISGYCVNTKYLTPEQKTELTQRVFHEVLSMDDALTN

SEQ ID NO: 10125 - DNA, 657 bp, Streptococcus agalactiae
atgaatcatcaaattttacaaaattacattaatagtcataatcttccaattatcgaaaaagactaccataaataccttacatttgaaagtttagaagaagactatacttatatcctaaaagatggtattgttaaacaaagtgttctctctaaatatggtactgagttcaatctgcgttatgtgacaggcttagaaatcacttctatcctaaatacagactactcccaacacatgggagaaccttacaacgttcgaatcgaatccgaaactgcccacttttacaaagtacgtcgctctaccttcctaaaagatatcaataatgatattgaactgcaaggatatgtgaaagatttctatcataaccgccttgaaaaatctatgaaaaaaatgcaatgtatgctcactaatggtcgaattggtgctatctccacacaattatatgacctcagtaagatgtttggtgaagaacgagataacggtgatatctatattaattttgttatcacgaacgaagaacttggtaaattttgcggaatatccacaggaagtagcgtgagccgcattttgaaacaactaaaagacgatcatattattcgtattgaaaaacaacatatcattattacaaatgttgagaaattaaaagatcatattgtattt

SEQ ID NO: 10126 - protein, 219 aa, Streptococcus agalactiae
MNHQILQNYINSHNLPIIEKDYHKYLTFESLEEDYTYILKDGIVKQSVLSKYGTEFNLRYVTGLEITSILNTDYSQHMGEPYNVRIESETAHFYKVRRSTFLKDINNDIELQGYVKDFYHNRLEKSMKKMQCMLTNGRIGAISTQLYDLSKMFGEERDNGDIYINFVITNEELGKFCGISTGSSVSRILKQLKDDHIIRIEKQHIIITNVEKLKDHIVF

SEQ ID NO: 10127 - DNA, 1746 bp, Streptococcus agalactiae
atgtttaaaatccctttgtttaaagaattaaagacagatcaatggataaaaccatttttcaaacaatataaagtttccttagtaattgctcttttccttggttttatgactttcttttctgccagtgctcttatgtttaattcgggctatctgattagtaagtcagcttcactaccgagtaatattcttctagtatatgttccaattgtactaacacgtgcttttggcattggacgtcctgtttttcgttatatagaacgcctaacgagtcacaattgggtattacgaatgacttcacagctgcgcttgaagctttaccattccttagaaagcaatgctatctttatgaagcgtgattttcgtttaggagatgttatggggcttttagcggaggatattaattatttgcaaaatttgtatcttaggacaatatttccaacgattatagcgtggatattatatagctttattattattgcaacaggcttcttttctctatggtttgctttaatgatgttgctttatttagctattatgatttttctttttccactttggtcgattttagctaatggtgctcgtcagactcgtgaaaaagaattaaaaaatcatctttatactgatttgacggataatgtcttaggtatttcagactggatttttagtcaacgtggtcaagagtacgtcgccttgcatgagcgttcggaaagtgaactcatggctgttcagaaaaaaattcgttcctttgataatcgtagagctcttattgtggaattagtttttggctttctagctattttggttattatttgggctagtaatcagtttattggtcacagaggtggcgaagctaactggattgcagcatttgttctaacagtatttcccttgtcagaggcatttgctggtttgtctgctgctgctcaagaaacaaataaatattctgattcaattcatcgtcttaatgaattatcagaaacgtattttgaaacaactcaaaatcagttgcctaataagccatacgatttttccgtcaagaatttaagtttccagtataagccacaagagaaatgggttttgcatcatttagatttggatattaaagaaggagaaaaaattgctattttagggcgtagtggttctggcaagagtaccttagccagtctacttcgtggcgacttgaaagcaagtcaaggggagattaccctaggcgatgctgatgtttcaatagttggtgattgcatttctaactatattggagtgatacaacaagcgccctacctttttaatacaaccctgctaaataacattcgcattggaaaccaagatgctagtgaagaagatgtatggaaagttcttgaacgagttggattgaaagagatggtcactgatttatcagatggtctctatacaatggttgatgaagctggacttaggttttcaggtggcgaaaggcatagaattgctttggctagaatcttactaaaagatgtcccaattgttatcttagatgagccaactgttggacttgatcctattactgaacaagccttactaagggtatttatgaaagaattggaaggtaagaccttagtttggattacacatcacttaaaaggtattgaacatgctgatcgtatcttatttatagaaaatgggcaattagagttggaaggttctcctcaagaattgtctcaaagtagccaacgttaccgtcagctgaaagcctctgatgatggtgatcta

SEQ ID NO: 10128 - protein, 582 aa, Streptococcus agalactiae
MFKIPLFKELKTDQWIKPFFKQYKVSLVIALFLGFMTFFSASALMFNSGYLISKSASLPSNILLVYVPIVLTRAFGIGRPVFRYIERLTSHNWVLRMTSQLRLKLYHSLESNAIFMKRDFRLGDVMGLLAEDINYLQNLYLRTIFPTIIAWILYSFIIIATGFFSLWFALMMLLYLAIMIFLFPLWSILANGARQTREKELKNHLYTDLTDNVLGISDWIFSQRGQEYVALHERSESELMAVQKKIRSFDNRRALIVELVFGFLAILVIIWASNQFIGHRGGEANWIAAFVLTVFPLSEAFAGLSAAAQETNKYSDSIHRLNELSETYFETTQNQLPNKPYDFSVKNLSFQYKPQEKWVLHHLDLDIKEGEKIAILGRSGSGKSTLASLLRGDLKASQGEITLGDADVSIVGDCISNYIGVIQQAPYLFNTTLLNNIRIGNQDASEEDVWKVLERVGLKEMVTDLSDGLYTMVDEAGLRFSGGERHRIALARILLKDVPIVILDEPTVGLDPITEQALLRVFMKELEGKTLVWITHHLKGIEHADRILFIENGQLELEGSPQELSQSSQRYRQLKASDDGDL

SEQ ID NO: 10129 - DNA, 390 bp, Streptococcus agalactiae
ttgaaacttggtcttgtctcagcaatgtttgctggaggagcattcgtagctcttggttctacacaaggtgtttcagcttcaactttcacagcaccgcaagcaacacctccaaaagcagaacgtcagttaacggattcagaactttatgaacgtgcccaaaaacaagtattgccaagatatatccaaggttctctctcaggtatccttaaccagcattcaacactttacaaacaacaaaatgcagcagtgacaccgcaagtatcaagccccaaatcagaacgtcagttaacagattcagaaatctatgaacgtgctcaaaaacaagtattgccaaattatattcaaggttctctctcaggtatcctcaaccaacattcaactttaaatgct

SEQ ID NO: 10130 - protein, 130 aa, Streptococcus agalactiae
MKLGLVSAMFAGGAFVALGSTQGVSASTFTAPQATPPKAERQLTDSELYERAQKQVLPRYIQGSLSGILNQHSTLYKQQNAAVTPQVSSPKSERQLTDSEIYERAQKQVLPNYIQGSLSGILNQHSTLNA

SEQ ID NO: 10131 - DNA, 534 bp, Streptococcus agalactiae
atgacagttgaaaagacggttagtgaattagctgaaattttaggggttagtcgtcaagcgatgaataacagagttaaaacactccctgaagaatgtgtggaaaagaatagtaaaggcgttacagttgttaatcgtgatggcttgattaaattggaagaaatctataaaaaaactattttggaagaggaaccaattgacgaagaagcatcaagacgagaacttttagaaattctcgttgatgagaagaatactgaaatcacacgtttatatgaacagttaaaagcaaaagatattcagattgcttcaaaagacgagcagttacatgtaaaagatattcaaatagcagagaaagataagcaattagatcaacaacagcaattgactttaactgctatggaagatacgcaacgtctgcaacttgagttaaatgaagctaaagcagaggttgaggagattcaagaagccaaagaagaaaaaattcaagaattagaagctgttaaaaaaagtttctttggacgtttcttcaataaaaaa

SEQ ID NO: 10132 - protein, 178 aa, Streptococcus agalactiae
MTVEKTVSELAEILGVSRQAMNNRVKTLPEECVEKNSKGVTVVNRDGLIKLEEIYKKTILEEEPIDEEASRRELLEILVDEKNTEITRLYEQLKAKDIQIASKDEQLHVKDIQIAEKDKQLDQQQQLTLTAMEDTQRLQLELNEAKAEVEEIQEAKEEKIQELEAVKKSFFGRFFNKK

SEQ ID NO: 10133 - DNA, 1125 bp, Streptococcus agalactiae
atgatggcagctatttcctcaaatttttacggcaacaaaacacttcttattgagaaaaataaacgtttaggcaaaaaactagctggaacaggtggtggccgctgtaatgttaccaataatggaaaccttgatgagctcttagctggtatacctggaaatggccgtttcctatatagcgtcttctcacaatttgataaccatgatattattaacttctttcaagacaacggcgtcacactaaaagaagaagatcatgggcgtatgttccctactactgataaatctcgtactatcattaacgcccttgaaaataaaataaaagaacttggtggtcaaattatgactgacacagaagttgtctctgtcaaaaagataggagattcattctatatcaaaactaaagatacacagttcgcatccgataaacttatcgtaacaactggtggtaaatcctatccgtctacaggttctactggtttcggtcatgacattgctcgtcactttaaattagaagtcacagatatggaagccgccgaaagccctcttttaactgattttccccataaaaaactacaaggtatctccttagatgatgtcactttgtcatttgaaaagcatattattacacacgatcttctctttactcattttggattatcaggaccagcagccttgcgaatttctagctttgtcaaaggcggagaaactatatacctagatgttttgcccaatatctctgttaaagaattggaaatacacttccaaaatgaaagagaaaaatctttgaaaaacgctcttaaaatacttcttcctgagcgtttagctgaattttacgctgaagacttacccgaaaaagtaaaacaagtatctgtaaaagacttagaaatgttaattcaaaaacttaaaaaacttcctattttagtaactggcaagatgtctctagcaaaatcctttgtaacaaaagggggagttgatcttaaagaaataaaccccaaaacacttgaaagtaaaaaggtagctggtttacattttgctggtgaagtcctagacatcaatgctcatacgggagggtttaacattacttctgccttatgtacaggctgggtagctggtagcttacactat

SEQ ID NO: 10134 - protein, 375 aa, Streptococcus agalactiae
MMAAISSNFYGNKTLLIEKNKRLGKKLAGTGGGRCNVTNNGNLDELLAGIPGNGRFLYSVFSQFDNHDIINFFQDNGVTLKEEDHGRMFPTTDKSRTIINALENKIKELGGQIMTDTEVVSVKKIGDSFYIKTKDTQFASDKLIVTTGGKSYPSTGSTGFGHDIARHFKLEVTDMEAAESPLLTDFPHKKLQGISLDDVTLSFEKHIITHDLLFTHFGLSGPAALRISSFVKGGETIYLDVLPNISVKELEIHFQNEREKSLKNALKILLPERLAEFYAEDLPEKVKQVSVKDLEMLIQKLKKLPILVTGKMSLAKSFVTKGGVDLKEINPKTLESKKVAGLHFAGEVLDINAHTGGFNITSALCTGWVAGSLHY

SEQ ID NO: 10135 - DNA, 765 bp, Streptococcus agalactiae
gtgagtagtcatgaagcaggagccatagaattttcagggcataaggtattgactttaccttctcataatgggaaattactcgcaagcgaagtcgcaacttatattgagactttttatgctgatggtaattaccaacacatggtttttccaggaatggtttatatatcacatccaacagaatatggaacactttatagtaaagcagaactagaagagttatcgaagatttgtaaacattatcaaatccccttatttattgacggtgctcgtctggggtatggtttggctgcgaaagatacagatgttgatttcccaacgattgcagccttatcagatgttttttatattggtggaaccaaaatgggggctcttgctggggaagcagttgttttcacaaagaaaaatcgtccaaaacagtttactacaattgtaaagcagcatggtgcgttattagccaagggaagattgctggggcttgcttttgatcgtttctttacggataacctttacttaaaaattggaaagcatgcgatcgacttagcagaggaattaaaaatcattttagaagaaaaaggttactcattctatttaaaatcaccaactaatcaacaatttattattgtagaaaatacaaaactagcagatttagcaaagaatgtagcttatagtttttgggaaaaatatgatgaccatcatactgtaatacgtctagcaactagttggtcaactagtcgcgaagatgtaactgctttaagaaatgtcttg

SEQ ID NO: 10136 - protein, 255 aa, Streptococcus agalactiae
MSSHEAGAIEFSGHKVLTLPSHNGKLLASEVATYIETFYADGNYQHMVFPGMVYISHPTEYGTLYSKAELEELSKICKHYQIPLFIDGARLGYGLAAKDTDVDFPTIAALSDVFYIGGTKMGALAGEAVVFTKKNRPKQFTTIVKQHGALLAKGRLLGLAFDRFFTDNLYLKIGKHAIDLAEELKIILEEKGYSFYLKSPTNQQFIIVENTKLADLAKNVAYSFWEKYDDHHTVIRLATSWSTSREDVTALRNVL

SEQ ID NO: 10137 - DNA, 405 bp, Streptococcus agalactiae
atggaatcatcagaacaagcactggctatatggagcgtactatctgatgtctatgacaaatctccgtggagtttatcgcagatttcagaagatttaaaaaaagattcaacagattatttttttgtttataatgacggtgaagtcattggttttttggctcttcaacaattggtaggtgaagtagaaattactaatattgctgttaaaaaaaattatcaaggtaaaggttatgcttaccagttaatgtcaatgatcgctgatatagaggtgccagtttttcttgaggttcgttattcaaatatcgtagcacaaaaactttatgagaggtgtggttttgtagttttaagaaagcgcaaaaattattaccatgatccaattgaagatgctatagtgatgcgcaaggga

SEQ ID NO: 10138 - protein, 135 aa, Streptococcus agalactiae
MESSEQALAIWSVLSDVYDKSPWSLSQISEDLKKDSTDYFFVYNDGEVIGFLALQQLVGEVEITNIAVKKNYQGKGYAYQLMSMIADIEVPVFLEVRYSNIVAQKLYERCGFVVLRKRKNYYHDPIEDAIVMRKG

SEQ ID NO: 10139 - DNA, 780 bp, Streptococcus agalactiae
atgataaaaatatttgatacccatacccaccttaacgtagaaaattttgaaggaaagatagacgaggaaattaatttagctagcgaactcggtgttacaaaaatgaatgttgtcggctttgaccaagataccatttcaaaatctttggaattatcttcccaatatgcacaggtatatagcacaataggatggcatccaactgaagctggttcttatgatgataatattgagtcaatgattatcagtcatttagaaaatcccaaggttattgcacttggtgaaattggtctggattattattggatggaggatcccaaagatattcagatcgaggtgtttaagcgtcaaattgaactttcaaaagagtataaccttccttttgtcgttcatacacgtgatgcgttagaagacacttatgaagtcattaaggaatctggagttgggccttttggtggtataatgcactctttttctggttctttggaaatggctcagaaatttattgatttagggatgatgatttccttttctggtgttgtgacctttaagaaggcattagatgtacaagaagctgcacgagagttgccattagataagatattagtggaaacagatgctccttatttggctcctgtacctaaaagaggtcgagaaaacaaaaccgcttatacgagatatgtcgttgaaaaaatagcagagctacgaggcataactgtggaagaggtagcggaggctacataccaaaatgcagtaaggatatttagacttgatgaaaaaaat

SEQ ID NO: 10140 - protein, 260 aa, Streptococcus agalactiae
MIKIFDTHTHLNVENFEGKIDEEINLASELGVTKMNVVGFDQDTISKSLELSSQYAQVYSTIGWHPTEAGSYDDNIESMIISHLENPKVIALGEIGLDYYWMEDPKDIQIEVFKRQIELSKEYNLPFVVHTRDALEDTYEVIKESGVGPFGGIMHSFSGSLEMAQKFIDLGMMISFSGVVTFKKALDVQEAARELPLDKILVETDAPYLAPVPKRGRENKTAYTRYVVEKIAELRGITVEEVAEATYQNAVRIFRLDEKN

SEQ ID NO: 10141 - DNA, 390 bp, Streptococcus agalactiae
atgaagtcaataaaattacttagttttattgtaataatccttttagggcttggtttcactgtaggaggtttaaaagtgactgaaaacaataaacaacaagaattatgggaaatagctaatagcaaagacgctaaaaatgcttatcaaaagtggatttatgcagaagatgaagatgctttcaaagagaatgctgttattaagtcgtatgatattgacaaagaaagtatcaaaaaaaatcctatgggagggatttcggtaaggttaatcattaataaagatcctaacttatatattacttgtaatttggatagggataatcaagggcatttggtcagtcaaagtagccatcaatctccccagttaactcatttattggaaagtagaggtcat

SEQ ID NO: 10142 - protein, 130 aa, Streptococcus agalactiae; identical to SEQ ID NO: 8910

SEQ ID NO: 10143 - DNA, 1533 bp, Streptococcus agalactiae
atgatacatgatatgattaaaacaattgagcattttgctgagacacaagctgattttccagtgtatgatattttaggggaagtccatacttatggacaacttaaagtagactctgactctctagctgctcatattgatagcctaggccttgttgaaaaatcacctgtcttagtattcggtggtcaagaatatgaaatgttggcgacatttgttgctttaacaaagtcagggcatgcttatataccggttgaccaacactctgctttggatagaatacaggctattatgacagttgctcaaccaagccttatcatttcaattggtgaatttcctcttgaagttgataatgtcccaatcctagacgtttctcaagtttcagctatttttgaagaaaagactccttatgaggtaacacattctgttaaaggtgatgataattactatattattttcacttcagggactactggtttaccaaaaggtgtgcaaatttcacatgacaatttattgagctttacaaattggatgatttctgatgatgagttttcagttcctgaaagaccgcaaatgttggctcaaccgccatattcatttgacttatcagttatgtattgggcaccaacactagctatgggaggcaccctgtttgccctaccaaagacagtagttaatgatttcaaaaaactattcgctaccattaatgaattgccaatacaggtttggacttcgacaccatcatttgctgatatggcgctactatctaacgatttcaattcagagaccttgccacagttaacacatttttattttgatggggaagagttaactgtcaagactgcacaaaaacttcgtcaacgttttccaaaagctcgtatcgttaatgcatatgggccaacagaagcaacagttgctctatccgcagtagcaattactgatgaaatgttagaaacatgcaaacgccttccaattggttacactaaagatgactcaccaacgtatgtgattgatgaagaaggtcataaattaccaaacggagagcaaggtgaaatcattattgctggaccagcagtatcaaaaggctatcttaacaatccagaaaagacagctgaggcatttttccaattcgaaggtctacctgcttaccataccggtgacttaggaagtatgaccgatgaaggtcttctgctttacggtgggcgtatggatttccaaattaaatttaacggctatcgtattgaattagaagatgtttctcaaaacttaaacaaatcgcagtatgtaaaatcagcagtagcagtgccacgttataacaaggatcataaagttcaaaacttattagcctatattgtcttaaaagaaggtgtaagagatgattttgaacgtgatttggatttgacaaaagcaattaaggaagacttaaaggacattatgatggattacatgatgccatctaaatttatctatcgagaggatttacctttgacaccaaatgggaaaattgatatcaaaggtcttatgagcgaggtaaacaag

SEQ ID NO: 10144 - protein, 511 aa, Streptococcus agalactiae [sequence omitted]

SEQ ID NO: 10145 - DNA, 2376 bp, Streptococcus agalactiae
atgtcagaatttgatacaaaatcatatttagaaaaacttgatgcatggtggagagcagctaattatatttctgcagcacaaatgtatctaaaggataaccctctcttgagacgagagctggttgaaaacgacttaaaggttcatccaattggtcactggggcactgtacctggacaaaattttatctatgctcacttaaatcgcgctattaataaatacgatttagacatgttctatattgaaggtccaggtcatggtggtcaagttatggtatctaattcatatttagatggttcatatactgaattaaacccaaatattgagcaaacagaggatggctttaagcagttatgtaaaatcttctctttcccatgtggaattgcatcccatgctgcaccagaaacaccagggtcaattcatgaaggcggtgaacttggttacgcactttctcatgcgacaggtgccatcctagacaatccagatgttattgctgcgactgttattggtgatggtgaaggtgaaacaggaccacttatggctggttggctatctaatacctttatcaatccagtaaatgatggtgctgttctaccaatcttctatttaaatggtggtaaaatccataacccaactatctttgaacgtaagacagatgaagaattatctcagttttttgaaggattaggttggaaacctatttttgcagatgttgttgaactctctgaggatcatgcggctgctcatgctttgtttgcagaaaaattagatcaagctattcaagagattaaaaccattcaatcagaagcacgacaaaaaccagcagaagaagctatccaagcaaaattccctgtcttagttgcacgtattcctaagggttggactggtccaaaagcttgggaaggaacaccaattgaaggtggcttccgcgctcaccaagtaccaattccagtagatgcccaccatatggaacatgttgattctcttttgtcatggcttcaatcataccgtccagaagaattatttgatgaaaatggtaaaatcgttgatgagattgctgctatttcaccaaaaggtgatcgtcgcatgtccatgaatccaataaccaatgctggtattgttaaagcaatggatacagcagattggaagaaatttgctcttgatattaatgttccaggtcaaattatggcacaagatatgattgaatttggaaaatatgcagcagatttggtagatgctaatccagataatttccgtatttttggtccagatgaaacgaaatcaaatcgtcttcaagaagtgtttacacgtactagccgtcaatggcttggtcgtcgtaaaccagattatgacgaagctttaagtccagctggacgtgttattgattcccaattgtctgaacaccaagcagaaggtttcttagaaggttatgttttaactggtcgtcacggcttctttgcttcatacgaatcattccttcgcgttgtagattcaatggtaacacaacatttcaaatggttacgtaaatcaaaaacacacacaacatggcgtaaaaattatccagcgcttaacctaattgcagcttcaactgttttccaacaagatcataatggttatactcaccaagatccaggtattttaactcatttagctgaaaaaacacctgaatacattcgtgaatatttaccagcagatactaactcacttctagctgttatggataaagcgtttaaagctgaagataaaattaatttaattgtgacatctaagcaccctcgtccacaattttactctattgctgaagcagaagagttagtggcagaaggatataaggtgattgactgggcttcaaatgtgtcgcttaatcaagagccagatgttgtctttgctgcggcgggaacagaacctaacttagaagctttggcagctattagcattcttcataaggctttcccagaacttaagattagatttgttaatgtattagacatcctaaaacttcgtcatccttcacaagatgctcgcggtttatcagatgaagagtttaacaaagtctttaccacagataaacctgttatttttgctttccatggttatgaagatatgattcgagatattttctttagtcgtcacaatcataatttgcatacgcatggttaccgtgaaaatggtgacatcacaacaccatttgatatgcgcgtgatgtcagaattggaccgattccatctggcacaggatgcagctcttgcttctttaggaaataaagcacaagccttcagtgatgaaatgaatcaaatggttgcttatcacaaagactatattcgtgaacacggagacgatattccagaagtacaaaattggaaatgggaaaatatcaag

SEQ ID NO: 10146 - protein, 792 aa, Streptococcus agalactiae
MSEFDTKSYLEKLDAWWRAANYISAAQMYLKDNPLLRRELVENDLKVHPIGHWGTVPGQNFIYAHLNRAINKYDLDMFYIEGPGHGGQVMVSNSYLDGSYTELNPNIEQTEDGFKQLCKIFSFPCGIASHAAPETPGSIHEGGELGYALSHATGAILDNPDVIAATVIGDGEGETGPLMAGWLSNTFINPVNDGAVLPIFYLNGGKIHNPTIFERKTDEELSQFFEGLGWKPIFADVVELSEDHAAAHALFAEKLDQAIQEIKTIQSEARQKPAEEAIQAKFPVLVARIPKGWTGPKAWEGTPIEGGFRAHQVPIPVDAHHMEHVDSLLSWLQSYRPEELFDENGKIVDEIAAISPKGDRRMSMNPITNAGIVKAMDTADWKKFALDINVPGQIMAQDMIEFGKYAADLVDANPDNFRIFGPDETKSNRLQEVFTRTSRQWLGRRKPDYDEALSPAGRVIDSQLSEHQAEGFLEGYVLTGRHGFFASYESFLRVVDSMVTQHFKWLRKSKTHTTWRKNYPALNLIAASTVFQQDHNGYTHQDPGILTHLAEKTPEYIREYLPADTNSLLAVMDKAFKAEDKINLIVTSKHPRPQFYSIAEAEELVAEGYKVIDWASNVSLNQEPDVVFAAAGTEPNLEALAAISILHKAFPELKIRFVNVLDILKLRHPSQDARGLSDEEFNKVFTTDKPVIFAFHGYEDMIRDIFFSRHNHNLHTHGYRENGDITTPFDMRVMSELDRFHLAQDAALASLGNKAQAFSDEMNQMVAYHKDYIREHGDDIPEVQNWKWENIK

SEQ ID NO: 10147 - DNA, 1515 bp, Streptococcus agalactiae
atgacttattaccttagtattgactacggcggtacaaataccaaggcgcttatttttgacaaattaggacaccaaatcgctgtttcgagttttgaaactttaaaaaatgagactcaatctggtcatcgtcaagtaaaccttgttaaaacgtggaatgctataacttctgctattagagaggttattcaaatctcaaaactcagccctgagcagattagtgcagtagcatgtattggacatgggaaaggtctttatctgctagataataagttggagccacttgaacaaggaattttgtctacagataatcgtgccaaagatttggcgcaatatttcgaatctaaacttgataatatttgggagttgactcggcaacatattttcccttcacaaagtccagttattttacgttggcttaaagattatcagcccgaaacctataaatcaataggggcggtcctttctgcaaaggactttattcggtataagcttacaggaaaagtacagcaagaatatggtgacgcttcaggtaatcattggataaatttccaaacaggaacttatgatccagctattttagatttttttggcattagagagatagaaaactcacttcctgaacttatagatagtgcagatttagttcctgggggaattagttctcaagcagcaaaagagactggtcttgtagaagggacccccgttgttggagggctctttgacatcgatgcttgtgctcttggatcaggtgttttagagtcagatacttttagtgttatttcgggaacttggaatattaatacatatccaagtttaaaaccagcaaagcaagatagtggtcttatgacttcctattttccagatcgtcgttatctcttagaggcaagtagccctacttctgcagggaatcttaattttatgttaaaaatgctcatgcatcaagaaattgataacgctaaatctagtggaggttctatctatgataatttagaagaatttctcactcatactgatgctacacatcatggacttattttctttccgtttctttacggtagtaacacatcacaagatgctagcgcttgcttttttgggctaacaactaaatcgacgaaatctcagatgatacgtgcggtatatgaaggtattgcgtttgcacataagcagcatatcactgatttaataaaaagtaggggcagtgtgccaaaaataattcgtttctctggcggagctaccaactcaccagcatggatgcaaatgttttctgatatcttaaactttcctattgaaacagtagaaggcacagaattaggagggttaggaggagctattttagcacgtcatgctttagataagatttcgttaaaggaagcagtccaagatatggttcgtgtaaaagctatttataaacctcaattatccgaagtaaaggggtacaaaaaaaaatatcacgcttaccaaaaattattagaaacactggatcctatttggtcggaactcggtcatctgaataag

SEQ ID NO: 10148 - protein, 505 aa, Streptococcus agalactiae
MTYYLSIDYGGTNTKALIFDKLGHQIAVSSFETLKNETQSGHRQVNLVKTWNAITSAIREVIQISKLSPEQISAVACIGHGKGLYLLDNKLEPLEQGILSTDNRAKDLAQYFESKLDNIWELTRQHIFPSQSPVILRWLKDYQPETYKSIGAVLSAKDFIRYKLTGKVQQEYGDASGNHWINFQTGTYDPAILDFFGIREIENSLPELIDSADLVPGGISSQAAKETGLVEGTPVVGGLFDIDACALGSGVLESDTFSVISGTWNINTYPSLKPAKQDSGLMTSYFPDRRYLLEASSPTSAGNLNFMLKMLMHQEIDNAKSSGGSIYDNLEEFLTHTDATHHGLIFFPFLYGSNTSQDASACFFGLTTKSTKSQMIRAVYEGIAFAHKQHITDLIKSRGSVPKIIRFSGGATNSPAWMQMFSDILNFPIETVEGTELGGLGGAILARHALDKISLKEAVQDMVRVKAIYKPQLSEVKGYKKKYHAYQKLLETLDPIWSELGHLNK

SEQ ID NO: 10149 - DNA, 645 bp, Streptococcus agalactiae
atgaaatactttttagatactgccgatgtttctgaaattcgtcgtcttaatcgtttaggaatcgttgatggtgttactaccaatccgactattatttcacgtgaggggcgtgactttaaagaagttattaacgaaatttgccaaatcgttgatggcccagttagtgcagaagtgacaggtttaacttgtgatgaaatggttaccgaagctagagaaatcgctaagtggtcaccaaatgttgttgttaaaattccaatgactgaagaaggtttagcagcagtttcacaattatcaaaagaaggtataaagacaaatgtgacattaatatttactgtggctcaaggtctttcggcaatgaaagctggtgcaacatttattagtccttttgtgggtcgtcttgaagatattggaacagatgcttatgctttgattcgtgaccttcgtcacattattgatttttatggtttccaatctgagattattgctgctagcattcgtggattggcgcatgtggagggcgtcgctaaatgcggtgcgcacattgccactattccagataaaacatttgcatcactatttactcacccgcttactgataaagggattgaaactttcttaaaagattgggatagtttcaagaagaag

SEQ ID NO: 10150 - protein, 215 aa, Streptococcus agalactiae
MKYFLDTADVSEIRRLNRLGIVDGVTTNPTIISREGRDFKEVINEICQIVDGPVSAEVTGLTCDEMVTEAREIAKWSPNVVVKIPMTEEGLAAVSQLSKEGIKTNVTLIFTVAQGLSAMKAGATFISPFVGRLEDIGTDAYALIRDLRHIIDFYGFQSEIIAASIRGLAHVEGVAKCGAHIATIPDKTFASLFTHPLTDKGIETFLKDWDSFKKK

SEQ ID NO: 10151 - DNA, 657 bp, Streptococcus agalactiae
ttggttgaaactagaccaaatgtcattgtctccagctccaaaacagctctattagagcatgatggtattagtggtgcagttgtgcaatcgaatagacaccgtggactaattgagaagccttatcatatcactttaattgagccaagcgatgaagaaatttatcgcttttctgctcttttgaaccgtgaaaagttttggttggaaaatgaacaggaaccaactattaggctttggtgttataaggttgatagctttgagattggaaaagacgaatttggtgcctgggtggtcgatgttaccttcatctgccaccctaccaagtttttcaagaccactgacatccagacattgactggtaatggggttttgagggttcaagggtcagctcttgcttttccgaagattacagtggttggtcagagcgcttctgagacatcgtttacgataggtaaccaagtgattaagcttgaaaagctctcagaatcgctcgtgatgaccaatgatcctgacaatcctagctttaagacggctagtggaaaactcattaagtgggctggtgattttatcacagttgatactgctaaggggcagaatgtcggtgttgttttaggtgctggcataacatctttgaaatttgaaacagtttgggggtgggca

SEQ ID NO: 10152 - protein, 219 aa, Streptococcus agalactiae
MVETRPNVIVSSSKTALLEHDGISGAVVQSNRHRGLIEKPYHITLIEPSDEEIYRFSALLNREKFWLENEQEPTIRLWCYKVDSFEIGKDEFGAWVVDVTFICHPTKFFKTTDIQTLTGNGVLRVQGSALAFPKITVVGQSASETSFTIGNQVIKLEKLSESLVMTNDPDNPSFKTASGKLIKWAGDFITVDTAKGQNVGVVLGAGITSLKFETVWGWA

SEQ ID NO: 10153 - DNA, 342 bp, Streptococcus agalactiae
atgggcggtggtagcgtgaagatgacaccgctaaaggtggatatcaagaatcaagttttagagaacattaagaaggctgcccaaagtacagaaaatgacattagaactggaagccctagacgaaacggtgtttacgaaaaaggttggacacacgacatcatagatgacgccgctgttgttcataataatggcaaagaaaaatctctatcccacctattagagaatggtcatgccactaaaaacggtggctttgttgcccctagagagcatatcagaccagcctacctcaagaataaggagaaattccttaatgatatgaaatccattaaaatcacacctaaa

SEQ ID NO: 10154 - protein, 114 aa, Streptococcus agalactiae
MGGGSVKMTPLKVDIKNQVLENIKKAAQSTENDIRTGSPRRNGVYEKGWTHDIIDDAAVVHNNGKEKSLSHLLENGHATKNGGFVAPREHIRPAYLKNKEKFLNDMKSIKITPK

SEQ ID NO: 10155 - DNA, 1260 bp, Streptococcus agalactiae
atgaaaaaatcactcattgagcttttggaagctcgtcaaaaagcaactgatgaactggctgaggtaaagcttaaaaaagccactattgaagcaaagatgaaatcttcaaccattgaagacgatgacttggaacagttaaaaactgatgcagaaagtttggtttctcaagcaacagctattaaggaaacaattgctgggctggattctgacattgaagaaactgaagaagaactcagcaaagctgctaaaatcattaaagaaaaacagaaaggtaatacacctatggattatttgaaaaccaaagccgctgctcttgactttgtccgtattctgatggacaacgaaggtagcgcaaacagtgcccgtaaagcgtgggaagctaaccttgttgaaaaaggagtgactaacctcactaagattcttccagaacctgttcttatcgctattcaagatgcctttactaactataatgggatcttgaaccacgtttcaaaagatccacgttatgcggtgcgtgttgctcttcaaactcaagtatctcaagctaaaggacacaaagctggtaagactaagaaagatgaagacttcacattcttggatttcactatcaactctgcgacagtttatatcaaatatgcctttgaatattctgacttgaagaaagatacaacaggcgcttacttcaactatgtgatgaaagaacttgctcaaggcttcatccgaactattgaacgtgctgttgtcattggtgatggaaaatctaacagtgctgaagacaaaatcactgaaatcaaatcaattgctgaagaaactgaagcgaatctctttgaaacacaagaaatcaatgttgctggtgtatttgacaatgctgttcttgaaacgctggttgctggtattgataagatggttccaaatactactccaattcttgtcacttcaaaagccattgctcgtaaattgaaattggtcaaagatgcagaaggtcgctacatcgatcctcaaccatttgctccaattgcaaccaacggaaatgttattgctggttttcaagtttacatctatgactggatggacggtgcaactaacccaatcattgcatttgctgaccaagcttataagatgattggtgatgaggctgccgctgaccgctttgatgattatgatgtaacagtcaaccgccgtcatattgagcttgctagtgttatgggtggtcgtttggctcagtacaaatcagcggttaagtttacaaacccagcaggt

SEQ ID NO: 10156 - protein, 420 aa, Streptococcus agalactiae
MKKSLIELLEARQKATDELAEVKLKKATIEAKMKSSTIEDDDLEQLKTDAESLVSQATAIKETIAGLDSDIEETEEELSKAAKIIKEKQKGNTPMDYLKTKAAALDFVRILMDNEGSANSARKAWEANLVEKGVTNLTKILPEPVLIAIQDAFTNYNGILNHVSKDPRYAVRVALQTQVSQAKGHKAGKTKKDEDFTFLDFTINSATVYIKYAFEYSDLKKDTTGAYFNYVMKELAQGFIRTIERAVVIGDGKSNSAEDKITEIKSIAEETEANLFETQEINVAGVFDNAVLETLVAGIDKMVPNTTPILVTSKAIARKLKLVKDAEGRYIDPQPFAPIATNGNVIAGFQVYIYDWMDGATNPIIAFADQAYKMIGDEAAADRFDDYDVTVNRRHIELASVMGGRLAQYKSAVKFTNPAG

SEQ ID NO: 10157 - DNA, 477 bp, Streptococcus agalactiae
ttgaaaatcaatgaagttttagaaaagctaggaataagtcgtgctacccttacaaggtatcgaaaaaagctgggcatatttgaagaaactaggtcaaatatcaccaaaagtcagttcaaagagttggaaaagcttgccaatcaacggcaaaagtacacaaggcaggaacgtgttgagctatctcgtaagactttcaagctgattccaaaagaaaaaatgcttgaaatcagtgataatgattcagttgggttgaaaaatctcaaaactcaatacaatcacaatcaaaaagtgattgaaaacttccagcttgaaatcaataaggtcatcaatgacggtgagctacctgataagtacctacttgatggaatggaaaagtatcaaaagcttaacatgcagatcatgtcaacgattgaaaagcaaagtccacagggtgacaggctcaaagaaatgattcaggagaagttagcacgttatggt

SEQ ID NO: 10158 - protein, 159 aa, Streptococcus agalactiae
MKINEVLEKLGISRATLTRYRKKLGIFEETRSNITKSQFKELEKLANQRQKYTRQERVELSRKTFKLIPKEKMLEISDNDSVGLKNLKTQYNHNQKVIENFQLEINKVINDGELPDKYLLDGMEKYQKLNMQIMSTIEKQSPQGDRLKEMIQEKLARYG

SEQ ID NO: 10159 - DNA, 345 bp, Streptococcus agalactiae
atgaagttaaggcttgaagaactaagaaacaaacttggcctcagtcgcagagatgtgcatgaagccactggcatttctatgaacacgctgctacattatgaaaaaggcggtacaccatctattggtcaggttgaaaatatcgctaaggcttacaatatcaacccagcctggttgcttggttggattgatgaaggccagcaaccacaaccacttgaaaccgttgttgaaaagattatctatgtggaaaaggaaggctgtagattaccgccatattggaacaatgataataatggcagaatcatcaagtggaaagaatcaagaagagcattccaaaggagaacaatt

SEQ ID NO: 10160 - protein, 115 aa, Streptococcus agalactiae
MKLRLEELRNKLGLSRRDVHEATGISMNTLLHYEKGGTPSIGQVENIAKAYNINPAWLLGWIDEGQQPQPLETVVEKIIYVEKEGCRLPPYWNNDNNGRIIKWKESRRAFQRRTI

SEQ ID NO: 10161 - DNA, 258 bp, Streptococcus agalactiae
atgaacgaatataagaaacccacctacatcgtcattcaagaggcaatggctgagcgtattagatttcttgaagatgaattatataacagagcatacaaagacattgaacggctagaagttgagaatgaccgtctgaaggttagatgccttgatttgcagttggaaaatgctgactatgtctgggatgacatgtgtcgctctgctattgctcgtgcaaaatcagaaaatcgaagaccacacagaagatggaggggaaga

SEQ ID NO: 10162 - protein, 86 aa, Streptococcus agalactiae
MNEYKKPTYIVIQEAMAERIRFLEDELYNRAYKDIERLEVENDRLKVRCLDLQLENADYVWDDMCRSAIARAKSENRRPHRRWRGR

SEQ ID NO: 10163 - DNA, 414 bp, Streptococcus agalactiae
atgatcaataatgttgtacttattggccgcttgacaagagatgttgagctacgttacacgccgtcaaacatcgcaaacgctacttttaacctagcagtcaatcgaaatttcaagaatgctgctggtgatcgtgaagctgatttcatcaactgtgtgatgtggcgacaacaagctgaaaacttggccaattggacgaaaaaaggaatgctgattggtattactggacgaatccagacaagaagctacgaaaatcagcaaggtcagcgtatctatgtgactgaggttgttgctgacagcttccagattcttgaaaagcgtgataattcaacgaaccaggcaagcatggatgaccaattgccaccatcatttggaaatagtcagcctatggatatttcagatgatgatctaccgttt

SEQ ID NO: 10164 - protein, 138 aa, Streptococcus agalactiae
MINNVVLIGRLTRDVELRYTPSNIANATFNLAVNRNFKNAAGDREADFINCVMWRQQAENLANWTKKGMLIGITGRIQTRSYENQQGQRIYVTEVVADSFQILEKRDNSTNQASMDDQLPPSFGNSQPMDISDDDLPF

SEQ ID NO: 10165 - DNA, 1311 bp, Streptococcus agalactiae
atgaaatttttagacctctttgctggcattggtggttttcgccttggaatggagcaagctgggcatgagtgcataggattctgtgaaataaataaatttgctagagctagctacaaagtaatacatgatactgaaggagaaattgaactacatgacatcacaagagtttcagatgagtttattcgaggaatcggaagtgtggacgttatctgtggcggatttccgtgccaggctttctcaattgctggaaatagacgaggttttgaagatacacgaggaactttgttctttgaaattgctaggttcgcatctattctcagacctaagtatctattccttgagaacgttaaaggactcctcaaccacgaagggggggctacattcgagaccatcatcagaaccttggatgaattggggtacaacgtggaatggcaaatctttaacagcaagaattttggagtcccccagaatagggaacgagtgtttattatcggacatcttagaggagaaggtaccagaccaatttttcctttcgaatcaagcatcacagaaaattatcctatccacaccagaaaaataggaaatgttaatccatctggtaatggaatgaatggggaagtgtatgattcggaaggtttatctccaactctaacaacaaataagggagaaggagttaaaatcgctgtaaatgttgtaggcagattacctgggaaatttgaaatgccaaatagagtctacgatccagatggcctagcaccgactatcagaactatgcaaggtggagggttagagccaaaaataattcagcgaggcagaggctataatcagggaggagaatatgaaatttctccaactgtcacatgcaacagttggcaagaaaacaatcttttaaagataaaagaagccactaaaaaaggctattcagaggcagaggctggcgattcagtaaacttatctcacccaaattctgagacaagacgtggacgagttggtaaaggtattgccaatactctcttgactggagaagaacaaggtgtggttgtttatgacttgtacaacagaagaaagaaagatattgttggcactttaacagctagcggtcataacggtaatactactacgggtacttttggtatctctaacggatttagaatcagaaagcttacacctcgtgagtgttggaggctacaaggcttccctgactgggcttttgacaaggcgagtcaggtcaatagcaacagtcaattatataaacaagctggtaatagcgtaacagtaaacgtcattgctgcaattgcaaggagattgcta

SEQ ID NO: 10166 - protein, 437 aa, Streptococcus agalactiae
MKFLDLFAGIGGFRLGMEQAGHECIGFCEINKFARASYKVIHDTEGEIELHDITRVSDEFIRGIGSVDVICGGFPCQAFSIAGNRRGFEDTRGTLFFEIARFASILRPKYLFLENVKGLLNHEGGATFETIIRTLDELGYNVEWQIFNSKNFGVPQNRERVFIIGHLRGEGTRPIFPFESSITENYPIHTRKIGNVNPSGNGMNGEVYDSEGLSPTLTTNKGEGVKIAVNVVGRLPGKFEMPNRVYDPDGLAPTIRTMQGGGLEPKIIQRGRGYNQGGEYEISPTVTCNSWQENNLLKIKEATKKGYSEAEAGDSVNLSHPNSETRRGRVGKGIANTLLTGEEQGVVVYDLYNRRKKDIVGTLTASGHNGNTTTGTFGISNGFRIRKLTPRECWRLQGFPDWAFDKASQVNSNSQLYKQAGNSVTVNVIAAIARRLL

SEQ ID NO: 10167 - DNA, 600 bp, Streptococcus agalactiae
atgaaaaaatttgaccactatttcagcaaccatattgctgtaaaaaacgaatctgatacagtcaccattgttgactattacaatccagaaaagggctatgagtataacttacgttacattttcgatagaaaaaattcatcccttgctatcacaggagactttggggaattagttgcacgaaatttctacaatatgggtgaatgggacacattctacaatcactatactggtcatctggggtattttcttgaaaagttactatgttcaagtaggccagttcattactatgatactgacaaggctaaaagagaaattctcaatgaattctttgatggtgctgattatgatgatttagattttgatgatgaattcctacttgatcaattatttgacaattttgacgaagataaaggatttacttatattcttccagaggcttttgaacgttttagcgaagatatggaagaatatgaggtctatgaatttctatcaagggctggccgatacgtcaatgatgtctttgaactttacttagacgcttataagagagcttatgagtatctaacaaaggaggttgatgatggcacaacgcagaatgtt

SEQ ID NO: 10168 - protein, 200 aa, Streptococcus agalactiae
MKKFDHYFSNHIAVKNESDTVTIVDYYNPEKGYEYNLRYIFDRKNSSLAITGDFGELVARNFYNMGEWDTFYNHYTGHLGYFLEKLLCSSRPVHYYDTDKAKREILNEFFDGADYDDLDFDDEFLLDQLFDNFDEDKGFTYILPEAFERFSEDMEEYEVYEFLSRAGRYVNDVFELYLDAYKRAYEYLTKEVDDGTTQNV

SEQ ID NO: 10169 - DNA, 282 bp, Streptococcus agalactiae
atgaatgatctaatgattcaaatgcttgaccagttcgaagctggtctaatggacagaacgatgaaagtaatgcacgttgtgacagacgaaaagtatagatttcctttagaactcaacaagtctcaatgcgctttaatgctcttaggtactaaagatactgggacatttgatgaacgctttaactgtcataaggattttccgaggattccaaatgctcgtgagaaataccctcgtgatgaagtcattgaatggtatcacaagaattggcaaagaactgttatc

SEQ ID NO: 10170 - protein, 94 aa, Streptococcus agalactiae
MNDLMIQMLDQFEAGLMDRTMKVMHVVTDEKYRFPLELNKSQCALMLLGTKDTGTFDERFNCHKDFPRIPNAREKYPRDEVIEWYHKNWQRTVI

SEQ ID NO: 10171 - DNA, 468 bp, Streptococcus agalactiae
atgaatttgaatcaaattcgtatcatagaggcatgccataaatttctaattggcatcacaaatttcgaagaagagttacaagatgacgttctcgtctatcgttacaaaggtaaccttgtcagctttgaaacctatcaagaatatgaacaacggtcatttgtagactataatctaaaatatggctatcttgatgacactagaacttacctagatgacagagctgatttgatagcagctttccctagcgaagagcacttgagagccttgcaaagagttaacgatgctgaacaagctcgtgtgcaaatctttaagctactatctcaggtcaatcttgactctctctccgaaaaaaattccaacatcaaaaaagataattttggatatgatttcttcaattttgcaactaaagaagaataccctgtttatcttttttcagatgatgaatcatttgagctagttgctatcagt

SEQ ID NO: 10172 - protein, 156 aa, Streptococcus agalactiae
MNLNQIRIIEACHKFLIGITNFEEELQDDVLVYRYKGNLVSFETYQEYEQRSFVDYNLKYGYLDDTRTYLDDRADLIAAFPSEEHLRALQRVNDAEQARVQIFKLLSQVNLDSLSEKNSNIKKDNFGYDFFNFATKEEYPVYLFSDDESFELVAIS

SEQ ID NO: 10173 - DNA, 1068 bp, Streptococcus agalactiae
atggcatcatatcgaaaaagagagaacgggctgtgggaataccgcatttcctacaaaaccatagatggaaaatataaacggaaagagaaaggtggttttaagaccaagaagcttgctcaggcggcagcaatcgaaattgaaaagaaattgacccaaaacatcttgacaaatgacgaagtaactctatatgactttgtcaagacctggtcagaagtctataagcgtccgtatgtaaaagataagacttgggaaacctattcaaaaaactttaagcacatcaagaactatttccaagagttgaaggtcaaagatattacaccgctttactaccaaaaaaagttgaatgagtttggcgagaaatatgcccaagaaactcttgagaaatttcactatcaaataaaaggggctatgaaagttgctgtaagggaacaggttgttacctttaattttgcagaaggtgcaaaagtgaaatctcaggtagagcccaaaaatgaagaggaagattttttagaggagcgcgaatataaggctctcttggcccttacaagagagaacatccaatatgtatcctatttcactctttaccttcttgcagtcacaggactgcgtttttctgaggctatggggctaacctggagcgatatagacttcaaaaatggcattttggatataaacaagagttttgattactcgaatactcaagattttgcagatctgaagaatgagtcatcaaaaagaaaagttccaattgattcaaatacaatagatattcttcgagaatataagaaaaatcattggcaagctaatatcaagaatagagtgtgctttggtgtatctaattcagcttgcaataaactgattaagaaaattgtgggtaggaaagtcagaaatcactcattacggcacacatacgcttcgtttttgattttgaacggggttgacattgtgacaatttctaagctccttggacatgaaagtccagatattactctgaaagtttatacacatcagatggaagcactggctgagagaaattttgagaaaatcaaaaatatttttttagtcgca

SEQ ID NO: 10174 - protein, 356 aa, Streptococcus agalactiae
MASYRKRENGLWEYRISYKTIDGKYKRKEKGGFKTKKLAQAAAIEIEKKLTQNILTNDEVTLYDFVKTWSEVYKRPYVKDKTWETYSKNFKHIKNYFQELKVKDITPLYYQKKLNEFGEKYAQETLEKFHYQIKGAMKVAVREQVVTFNFAEGAKVKSQVEPKNEEEDFLEEREYKALLALTRENIQYVSYFTLYLLAVTGLRFSEAMGLTWSDIDFKNGILDINKSFDYSNTQDFADLKNESSKRKVPIDSNTIDILREYKKNHWQANIKNRVCFGVSNSACNKLIKKIVGRKVRNHSLRHTYASFLILNGVDIVTISKLLGHESPDITLKVYTHQMEALAERNFEKIKNIFLVA

SEQ ID NO: 10175 - DNA, 234 bp, Streptococcus agalactiae
atgtctcaattatctttggaagaacaattgaatcgactaaaagataaatacctttcttctaaaaatcaagaattttcaaatgttcacttaagtaaagtaaagaagaaaaagaagaaattaataatacttgaaaaagaaagatgtcgctgtcgattggagagagaagatactaaaaaaatcgatgataaaattgagaaattgaagaaagaattgatagatgttatgaaggaggaa

SEQ ID NO: 10176 - protein, 78 aa, Streptococcus agalactiae
MSQLSLEEQLNRLKDKYLSSKNQEFSNVHLSKVKKKKKKLIILEKERCRCRLEREDTKKIDDKIEKLKKELIDVMKEE

SEQ ID NO: 10177 - DNA, 642 bp, Streptococcus agalactiae
atggatatagaaaactactgccaagactactgtttggagactatctttccaaaacattatttcaaggatttacaagtaatcaccctaactgccggccaatccgtctgtaaacagggagaacaattagaatacttgcactacatcgtcaagggacgttttaaaattgtacgtcgactctttaacggcaaagaacatattttagatattaaaacaaaaccaacactgattggtgatattgaacttttgactaatagacaaattgtatcatctgttattgccttagaggatcttacagtcattcaattatcacttaaaggacggaaagagaaactgttaacagacgcaactttcctcctaaaacttagtcaagagctagctcaggcttttcatgatcaaaacatcaaagcgtctactaatctagggtataccgtcaaagagttacttgcaagtcatattttagcaattgaagaacaaggttactttcaacttgagttaagtagtttagctgattcgtttggcgtcagttatcgtcatttattaagagttatccacgatatggtcaaagaaggccttatccaaaaagaaaaaccaaaatactttatcaaaaatcgtttcgcactagaatcattaaatattcagcca

SEQ ID NO: 10178 - protein, 214 aa, Streptococcus agalactiae
MDIENYCQDYCLETIFPKHYFKDLQVITLTAGQSVCKQGEQLEYLHYIVKGRFKIVRRLFNGKEHILDIKTKPTLIGDIELLTNRQIVSSVIALEDLTVIQLSLKGRKEKLLTDATFLLKLSQELAQAFHDQNIKASTNLGYTVKELLASHILAIEEQGYFQLELSSLADSFGVSYRHLLRVIHDMVKEGLIQKEKPKYFIKNRFALESLNIQP

SEQ ID NO: 10179 - DNA, 423 bp, Streptococcus agalactiae
atgggaaactttaaaaattcagcggttaaatctatggttgtcatgcgaaaagcatttagaacaatagacggaaaagtctcagaatcatttaaagaatttgaattaacaccaactcagtttgcagttttggatgttctctatgctaaaggcacaatgaaaattggagaattgattgaaaatatgcttgctacatcaggtaatatgactgttgttattaaaaatatggaaaaaaagggatgggtattacgccattcttgtccgaatgataagagagcctttttggtgagtttaacaactgaaggagaagaagtgataaaaaaagctctaccagagcatattaaacgtgtagaagatgctttttcagtcttaacagaaacagagcaagaagacttgattaaccttttaaaaaaatttaaaaccttg

SEQ ID NO: 10180 - protein, 141 aa, Streptococcus agalactiae
MGNFKNSAVKSMVVMRKAFRTIDGKVSESFKEFELTPTQFAVLDVLYAKGTMKIGELIENMLATSGNMTVVIKNMEKKGWVLRHSCPNDKRAFLVSLTTEGEEVIKKALPEHIKRVEDAFSVLTETEQEDLINLLKKFKTL

SEQ ID NO: 10181 - DNA, 1836 bp, Streptococcus agalactiae
atgcttattccaacacttcgcgaaatgccaagtgatgctcaggttatcagccatgctcttatggttcgtgcaggatatgtccgccaagtttcggctggaatctatgcttatttgcctctagctaaccgtactattgaaaaatttaaaacaattatgcgtcaagaatttgagaagattggtgcagttgaaatgttagctccagctcttcttacagcagatttatggcgtgaatctgggcgctacgaaacatatggtgaagacctttataaattaaagaatcgtgatcaatcggattttatcttaggaccaactcatgaagagactttcacaactcttgttcgtgatgcagtaaaatcttataagcaattaccactaaacctttatcaaattcagtctaaatatcgtgatgagaagcgtcctcgtaatggacttcttcgaacacgtgaatttatcatgaaagatggatacagcttccacaaagattatgaagaccttgatgtcacttacgaagattaccgtaaagcatatgaagccatcttcacacgtgctggacttgactttaaaggcattataggtgacggaggtgctatgggaggtaaagatagccaagaatttatggcagtaactcccaatcgtacagatttaaatcgttggttagtccttgataaaactattccttctattgatgatattccagaggatgttttagaagaaattaaggtagaactctcggcttggctagtttctggtgaggacactattgcatactctactgaatcaagctatgctgctaaccttgagatggcaacgaatgagtacaaaccatctactaaggctgctacctttgaagaagtaacaaaagtagaaactcctaactgcaaatcaattgatgaggtagctggatttttatcaattgatgaaaatcaaactatcaagacactattgtttattgctgatgaacagcccgtggttgctttactagttggtaacgatcaagtcaatgatgtgaagttaaaaaattatttagcggctgatttcttagagcctgcaagtgaagagcaagcaaaagagatttttggtgcaggttttggttctcttgggccagttaacctacctgactctgttaaaattattgctgatcgtaaagttcaagaccttgctaatgctgtgtctggtgctaaccaagatggttatcattttactggagttaatccagaacgtgatttcacagctgaatacgttgatattcgtgaagtaaaagaaggggagatttctccagacggtaaaggtactctgaaatttgctcgtggtattgaaattggacatatctttaaactaggtacccgttattcagatagtatgggagcgaacatccttgatgaaaatggccgctcaaatcctattgttatggggtgttatggtattggtgttagtcgtattctctcagctgtcattgaacaacatgcccgactttttgtgaataagacaccaaaaggagcttatcgctttgcttgggggattaatttcccagaagaattagccccatttgatgtacatttgattactgtcaatgtcaaagatcaagagtcacaagaccttactgagaaaattgaagctgatttgatgcttaaaggttatgaagtcctgacagacgatcgtaatgaacgtgttggttctaaattctcagacagtgacttaattggacttccaattcgagtaactgttgggaagaaagcttctgaaggtatcgttgaagtgaaaattaaagcaagtggtgatacgattgaggttcacgctgataacttaattgaaactttagagattctaacaaaaaaa

SEQ ID NO: 10182 - protein, 612 aa, Streptococcus agalactiae
MLIPTLREMPSDAQVISHALMVRAGYVRQVSAGIYAYLPLANRTIEKFKTIMRQEFEKIGAVEMLAPALLTADLWRESGRYETYGEDLYKLKNRDQSDFILGPTHEETFTTLVRDAVKSYKQLPLNLYQIQSKYRDEKRPRNGLLRTREFIMKDGYSFHKDYEDLDVTYEDYRKAYEAIFTRAGLDFKGIIGDGGAMGGKDSQEFMAVTPNRTDLNRWLVLDKTIPSIDDIPEDVLEEIKVELSAWLVSGEDTIAYSTESSYAANLEMATNEYKPSTKAATFEEVTKVETPNCKSIDEVAGFLSIDENQTIKTLLFIADEQPVVALLVGNDQVNDVKLKNYLAADFLEPASEEQAKEIFGAGFGSLGPVNLPDSVKIIADRKVQDLANAVSGANQDGYHFTGVNPERDFTAEYVDIREVKEGEISPDGKGTLKFARGIEIGHIFKLGTRYSDSMGANILDENGRSNPIVMGCYGIGVSRILSAVIEQHARLFVNKTPKGAYRFAWGINFPEELAPFDVHLITVNVKDQESQDLTEKIEADLMLKGYEVLTDDRNERVGSKFSDSDLIGLPIRVTVGKKASEGIVEVKIKASGDTIEVHADNLIETLEILTKK

SEQ ID NO: 10183 - DNA, 849 bp, Streptococcus agalactiae
atggattttaaggaactgtttccagaagttattactaaacaggaagttaaacagagtgaggattatatcatcgttgagcaagatggtcatgtcctccactttccaaaatcttcgctaactaagcgtgaactatacttattacaaatgacaccaagcctggaagatgcgagttcagtggattctcagaatccttggtaccgctatctagttgaaggtcgtggaaggttgccccaatctcattcggcagtccaatttatttttattgagcatcaatttaccttatcagaagaacttaaggatttcttgtcgcctttagtaataaacgtagaaacaattatgacaattaatcaaacccaaagtgtcatgattttaaatcaggataatttctttaatgctacggaattactaacagatattttaccaacgattgaaaatgactttaacacgcgtttaaggtgctattttggaaatagttggacgcatctacaagcagtggactggaaagaattatatgaagaagaatataaactttttacgctttttcttagtcacaaggccgaacaacattactgtcgatttccaaagatggctttatgggctttggcaaatcaatcgcccatgccttctattaaagcaaaatgtttacaacatatccttgatacgagtgatacttcggctataataaaagccctgtggcaagagcaaggaaatcttgctaaaacggctaaggcacttttcattcatcggaattcattgcaatataaattagataaatttacccaatcttcgggacttaatttaaaaatattagatgatttagcctatgcctatttgatttcgatggatacc

SEQ ID NO: 10184 - protein, 283 aa, Streptococcus agalactiae
MDFKELFPEVITKQEVKQSEDYIIVEQDGHVLHFPKSSLTKRELYLLQMTPSLEDASSVDSQNPWYRYLVEGRGRLPQSHSAVQFIFIEHQFTLSEELKDFLSPLVINVETIMTINQTQSVMILNQDNFFNATELLTDILPTIENDFNTRLRCYFGNSWTHLQAVDWKELYEEEYKLFTLFLSHKAEQHYCRFPKMALWALANQSPMPSIKAKCLQHILDTSDTSAIIKALWQEQGNLAKTAKALFIHRNSLQYKLDKFTQSSGLNLKILDDLAYAYLISMDT

SEQ ID NO: 10185 - DNA, 894 bp, Streptococcus agalactiae
atggctattacgatacaaaatcatgagttgcaagtgacattaaaagcgttaggtgcaacaatgacttctattacagatagtcaaggcgttgagtacctttggcaaggggacgccacttattggggtgggcaagctcctattttatttcctatatgcggaagtgttcgaaatgattgcgtcatttacagaccagctcaagctccacattttacgggtatcataccaaggcatggctttgtacgtcacaaaacattcgactatgattacatatcggattcttctgttcgttttacaattaaaagtagtaaagaaatgttgataaattatccttatcgttttagtttagaaataacttacaccttaagaaataaaagcattgccattacatatattgtcaaaaacttagaatcagaaaaaaatatgccatatgctatcggagctcacccaggctttaattgccctttgtttgaaaaggaagtatttagtgattactatctagagtttgaacagtttgaaacttgcacaattcctgagtcgtttccggatacaggcttgttagatttacaagctagacatccttttttagaaaatcaaaaacaattatctcttaatcatgctttatttgaaaaagatgctattactttagaccaactacgatctaagacggtttacttaaaatctagaaatcatgcaaaaggaatccaacttgactttgatgattttgagaatcttattctttggacaagtaacaatggtggtccttttttggctttggaaccctggagttctttgtcaacttctattgaagagtctgatattttagaagataaacaaaatatcgtacggcttaatccaaagcagtcgaaacagcattctattcggatcactatttta

SEQ ID NO: 10186 - protein, 298 aa, Streptococcus agalactiae
MAITIQNHELQVTLKALGATMTSITDSQGVEYLWQGDATYWGGQAPILFPICGSVRNDCVIYRPAQAPHFTGIIPRHGFVRHKTFDYDYISDSSVRFTIKSSKEMLINYPYRFSLEITYTLRNKSIAITYIVKNLESEKNMPYAIGAHPGFNCPLFEKEVFSDYYLEFEQFETCTIPESFPDTGLLDLQARHPFLENQKQLSLNHALFEKDAITLDQLRSKTVYLKSRNHAKGIQLDFDDFENLILWTSNNGGPFLALEPWSSLSTSIEESDILEDKQNIVRLNPKQSKQHSIRITIL

SEQ ID NO: 10187 - DNA, 930 bp, Streptococcus agalactiae
atgattttaacagtaactttgaacccttctattgatatttcgtactgcttagaaaactttaacatggatactgtaaatcgagttaccgacgtctccaaaacacctgggggtaaggggttaaatgtgactcgtgttctttctcaacttggcgataatgtagtggcaactggtctattagggggggattttggagatttcatccgaagtggcttagatgcattggaaatcagacaccaatttttaagtattggtggagaaacacgtcattgtattgcagttttacatgagggtcagcagactgaaattctagaaaaaggtccacatattactaaagatgaagcagacgcctttttgaatcatctaaaacttatctttgatgctgcaactatcataacagtatcaggaagtttaccaaagggactcccctcagattattatgctaggttaatctccctagcgaatcactttaataagaaagttgttttagactgttcaggagaagcattacgttcggttttaaaatctagtgctaagccgaccgtcattaaacctaaccttgaagaattaacacaattaattggaaaaccaattagctatagtttagacgaattaaaatctaccttacagcaagatctttttagaggaattgattgggttattgtttctttaggtgctaggggagcttttgctaaacatgggaatcactactatcaagtgacgattccaaaaatagaagttattaatccagttggttcaggggatgcaacggttgcaggaatcgcgtctgctttggaacatcaactagatgatacaaatttgcttaagagagctaatgtcttgggtatgcttaatgcacaagaaacattaacagggcatatcaatctgacctactatcaagaattaatcagtcaaatccaagtgaaagaggta

SEQ ID NO: 10188 - protein, 310 aa, Streptococcus agalactiae
MILTVTLNPSIDISYCLENFNMDTVNRVTDVSKTPGGKGLNVTRVLSQLGDNVVATGLLGGDFGDFIRSGLDALEIRHQFLSIGGETRHCIAVLHEGQQTEILEKGPHITKDEADAFLNHLKLIFDAATIITVSGSLPKGLPSDYYARLISLANHFNKKVVLDCSGEALRSVLKSSAKPTVIKPNLEELTQLIGKPISYSLDELKSTLQQDLFRGIDWVIVSLGARGAFAKHGNHYYQVTIPKIEVINPVGSGDATVAGIASALEHQLDDTNLLKRANVLGMLNAQETLTGHINLTYYQELISQIQVKEV

SEQ ID NO: 10189 - DNA, 513 bp, Streptococcus agalactiae
atgaaaattgcggtcggttgtgatcatattgtaacttatgacaaaattgcagttgtggattatttaaaaacaaaagggtatgaggttattgattgtggaacttatgataatatccgtactcactatcctatttatggtaagaaagtaggagaagctgtcgctagtggaaaagccgacttaggtgtatgtatttgtggaactggagttggtattaataatgctgttaataaagttccaggaattcgctcagctctggtacgtgatttgacatcagctatctatgccaaagaagaattaaatgctaacgttatcggatttggtgggaaaattactggtgggctgttaatgacagatatcatcgaggcgtttataagagctaaatataaaccaacaaaagaaaacaaagtattaattgaaaagatagccgaggttgagactcataatgcccatcaagaagagaatgactttttcacagagttcttagataaatggaatcgtggtgaatatcacgac

SEQ ID NO: 10190 - protein, 171 aa, Streptococcus agalactiae
MKIAVGCDHIVTYDKIAVVDYLKTKGYEVIDCGTYDNIRTHYPIYGKKVGEAVASGKADLGVCICGTGVGINNAVNKVPGIRSALVRDLTSAIYAKEELNANVIGFGGKITGGLLMTDIIEAFIRAKYKPTKENKVLIEKIAEVETHNAHQEENDFFTEFLDKWNRGEYHD

SEQ ID NO: 10191 - DNA, 2448 bp, Streptococcus agalactiae
atgacattaacctttgggaaaccttctataacgatacgccgtctaggagtgataactagtacatatatgatgctaggttttatcttattatgtggatttttgcatcctagtacaatttatagtgaggaaataaaatctgatataaactcttttatatcaatagatgatgaaaaaactactgttcccatatttgactctactttagataagcttactaattcaatagaggagaggcagttagaattagattctgatacatcggacagtttaatagtagatgatcaaaaagataaagatatggtaatagtcttaggtgattctgacagtcaagaaaaattgtcacctcctctaaaatcggaaatagcgacagaagaaaatcgtaaacaggcaaatttagcagaactaaatgcaactcaacctaataatagaactacctatattatacccgaaagcagtcattccattgcagaacaacagagattcctgatagaatcaaagggttattcggttgcattacttaatagcgatgaatttagaaagacagcgagagaggatagaggttttgaaagggataagttgaggtctttggatatcattcctaagggagatttatcgacaagtaatgtcataggtaatacggacattgctagtcagatatcgttgggctttaaaaagaatgcgatacaggaacaccatcttactaaaacattctctcaaaaggatggaaagttatcgtctgttatagaggggatgcttgctattggcaaagagaaagtagagaaggaaataaaatatagtggtaatttatggcaaaaattaaaagctaaggcacactgccttgtttgctgtgttgataatttgaattttgaagatataaaatcttattttcaatattattgtcatctaaaccatcagctcaaattacctaaaggtgctatactttctgctaaaacagaagtatataggggaggagattttgggagaaaaaataaagataatgtgtttggttaccgtatcccctcattattaaaaacggaaaaaggaactttacttgtgggagctgatgaaagaattgagcaagcttgtgattggggaaacataggaatggttattcgccgtagtgaggatgatggtgtcacttggggaaaaagagaaactattgtcaatctccgtaataaccctagagttccgctagttactagtggtgactatagtggctcacctattaatatggatatggcattagttcaagatactagctctaagacgaaacgtattttttcaatatatgatatgtttccagaaggaagaggcgttattagtattgctaacacacctgaaaaagaatatacccaaatcggaggacagtcttatcttaatttatataataatggaaagaaatcgaaggtttttactatccgtgacaaaggtattgtatataattttaaagggaaaaagactgattatcatgttataacagaaactactaaaagtgaccattcaaatctaggggatatttataagggaaaacagctacttggaaatatatattttacaaaacataaaacgtcaccatttcgtttagcaaaatcaagctatgtgtggatgtcatatagcgatgatgatggtaggacatggtcatcacctagagatataacagcaagtcttcgtcagaaaggcatgaaatttttaggaataggacctggaaaaggtatagttttaaaatgggggccacacgctggtcgtattattattcctgcctattctacgaattggaaatctcatctaagaggttcacaatcttcacgcctaatttattcagacgaccatggaaaaacgtggcatactggaaaagcagtcaatgataaccgtatactttctaatggtgaaaaaattcactccttaacaatggataataaaaaagaacaaaatacagaatccgtacccgttcaattgaaaaatggggacattaagttatttatgaggaatctaactggtaacctagaagtagccacaagtaaagacggcggggagacttggcaaaaccatgttaaacgatataaggaagttcatgatgcttacgtccaattatcagctattcgctttgagcatgacaaaaaagagtatattttattagtgaatgctaatgggccaggtaagaagcgtcaagatggatatgcacgtctagcgcaagttaatcgaaatggtagttttaagtggttatatcaccatcacattcaagatggttcgtttgcttacaactctgttcaacaacttaataatgataaatttggtgtcctttatgaacatagagaaaaacatcaaaatagttttactttaaattacaaagtttttaattggagttttcttagtcaaaatacagagaagcaaggcactttatgggagaaaatggcagcaaattggcatgttttgtttaaattttattta

SEQ ID NO: 10192 - protein, 816 aa, Streptococcus agalactiae
MTLTFGKPSITIRRLGVITSTYMMLGFILLCGFLHPSTIYSEEIKSDINSFISIDDEKTTVPIFDSTLDKLTNSIEERQLELDSDTSDSLIVDDQKDKDMVIVLGDSDSQEKLSPPLKSEIATEENRKQANLAELNATQPNNRTTYIIPESSHSIAEQQRFLIESKGYSVALLNSDEFRKTAREDRGFERDKLRSLDIIPKGDLSTSNVIGNTDIASQISLGFKKNAIQEHHLTKTFSQKDGKLSSVIEGMLAIGKEKVEKEIKYSGNLWQKLKAKAHCLVCCVDNLNFEDIKSYFQYYCHLNHQLKLPKGAILSAKTEVYRGGDFGRKNKDNVFGYRIPSLLKTEKGTLLVGADERIEQACDWGNIGMVIRRSEDDGVTWGKRETIVNLRNNPRVPLVTSGDYSGSPINMDMALVQDTSSKTKRIFSIYDMFPEGRGVISIANTPEKEYTQIGGQSYLNLYNNGKKSKVFTIRDKGIVYNFKGKKTDYHVITETTKSDHSNLGDIYKGKQLLGNIYFTKHKTSPFRLAKSSYVWMSYSDDDGRTWSSPRDITASLRQKGMKFLGIGPGKGIVLKWGPHAGRIIIPAYSTNWKSHLRGSQSSRLIYSDDHGKTWHTGKAVNDNRILSNGEKIHSLTMDNKKEQNTESVPVQLKNGDIKLFMRNLTGNLEVATSKDGGETWQNHVKRYKEVHDAYVQLSAIRFEHDKKEYILLVNANGPGKKRQDGYARLAQVNRNGSFKWLYHHHIQDGSFAYNSVQQLNNDKFGVLYEHREKHQNSFTLNYKVFNWSFLSQNTEKQGTLWEKMAANWHVLFKFYL

SEQ ID NO: 10193 - DNA, 462 bp, Streptococcus agalactiae
gtgactcaagatattttatttattgatgcccattctcaggaagaattatttgacttagtatcaaaagcattgataaaacaacactatgttagtcctaactaccgacaggcagtaaaagaaagggagagagagtttccaacggggttaaaaattgatttaaaagatgggactcctattcaatatgttgctattccacacactgaaacgcagtattgtctagtagatagaatcttttatgtcaaaaatagtcagccaattactttcaaacatatgattaatccagaagaggagtgtagggttcaggattttttcttcatcattaatagtaggaatagtaaccaaagtgatattttatctaatttgattaccttctttattacaaaaggaaacctagatcggctacatgagcttggcgacaataaagaaaaaattaatcattatttaatagaaaaaggagtgttt

SEQ ID NO: 10194 - protein, 154 aa, Streptococcus agalactiae
MTQDILFIDAHSQEELFDLVSKALIKQHYVSPNYRQAVKEREREFPTGLKIDLKDGTPIQYVAIPHTETQYCLVDRIFYVKNSQPITFKHMINPEEECRVQDFFFIINSRNSNQSDILSNLITFFITKGNLDRLHELGDNKEKINHYLIEKGVF

SEQ ID NO: 10195 - DNA, 894 bp, Streptococcus agalactiae
atggtttctctaaaaggaaaaaatgatactaaacatcgcatgataactgctcaccttgatacacttggtgctatggttagggccatcaaaccagatggtcggttaaaaattgaccttattggtggatatacatacaatgccattgaaggagaaaactgtactatacacctctcaaaaaatggtaaagaaatttctggaactgctcttattcatcaaactagtgtccatgtttacaaagacgctggaactgctgaacgtaatcaaacaaatatggaaattcgtttagatgagaaagtaacaactgctgacgaaacacgtgctttaggcatccaggtcggtgatttcatttcatttgatccgcgtacaatcataacagacagcggctttattaaatcacgttacctagatgacaaggtatccgctggtatcctaatggaacttctttctgtttacaagaaagaagacattcaacttccttatactactcatttctactttagtgcctttgaagagctaggacatggagcaaattcaagcatcccaaatgaaactgtagaatatctagcagttgatatgggagctatgggagacgatcaagaaactgacgaatatactgtctctatctgtgttaaagatgcttctggtccttatcattatgaattacgtcaacatcttgtttctctagctgaaaacaataatattccttataaacttgatatttatccttattatggtagtgacgcctccgctgccatgcgtgctggtgcggaagttaaacacgcgctacttggtgcaggtattgaatctagtcattcttatgaacgtacccatatcgattctattcaagcaactgaactcttagtggatgcctatctcaaaagcaatatggtggac

SEQ ID NO: 10196 - protein, 298 aa, Streptococcus agalactiae
MVSLKGKNDTKHRMITAHLDTLGAMVRAIKPDGRLKIDLIGGYTYNAIEGENCTIHLSKNGKEISGTALIHQTSVHVYKDAGTAERNQTNMEIRLDEKVTTADETRALGIQVGDFISFDPRTIITDSGFIKSRYLDDKVSAGILMELLSVYKKEDIQLPYTTHFYFSAFEELGHGANSSIPNETVEYLAVDMGAMGDDQETDEYTVSICVKDASGPYHYELRQHLVSLAENNNIPYKLDIYPYYGSDASAAMRAGAEVKHALLGAGIESSHSYERTHIDSIQATELLVDAYLKSNMVD

SEQ ID NO: 10197 - DNA, 1647 bp, Streptococcus agalactiae
atgagaggatatagaatggaagaacgctttaagaaacgactacaagatgatatctctaaacatttttcccgccagtctttaattttatccttgttattgattgcacttttcgtccttttttctttagcgcctcaacagataggtctttataaagatgttaattcagtttcctatagttataagcaattgattcaaaaacatgataccttattagatgacttaggtaaaaatagtttgaaaccatttgtctcaggacacttaggaagtgctgatttgagtaagcaatattatcatttaaggaatcatttacaaagtcaaacagaacttttagtattctcacctaatcaagaacttttgtttgctagtaattcacatttaggtaatttttttagtaagtctatttacattagtgaagttttagataaggctaaaataaatcaaaggctactaaaaattattgtggatagtgagggagggcattaccttgcactcattaagccaattatagttaataaaaaagtttcaggttatgcctttttattgatgaatgggaaagactttttacttccaacgaaggctattaactcagacttgattattgccgatcagctaaataatagctttacttttactaatcgtgattttatctcctctagtttagataaggtagatagtcaattcttaactagatattttagttttcacgatcatcgagcttttgttgttaggaaagtagctctgcaagacaatatcctactttacatgtatcgtcccctgataccagtaactctggtcgtccttttttctctagtatcatcagttattatttttgtgattttacgacaaaaatctagagttctagccgatcgcatcgcagtaaaaaattctagcgccataaatcaaatggtgctagatatggatgccatttcccgccaagaaaaatctagtattgagcttgatagtcaagatgaatttcaatatctatctgtgcaaatcaatcagatggtttcacggttaaaagatttacatgagaaaactcttgatttggaaacacaaaagttgttgtttgaaaagaggatgttagaagctcagtttaatcctcacttcctttataatacccttgagacaattttaataaccagtcactatgattcacaattaacagaaagaatcgttatacaactaacaaaattattgcgctatagccttagtggtagcacagaagcagctgtgcttaaggatgatttagcaatcattgaatcctaccttttgattaatcaagtgagatttgaagaattaacttacactatttcagtatctcctgaacttgaacacatgcgtgtaccaaaacttttcttgttaccgctaattgagaatgctattaaatatggcttaaaagaacgtcatgatgtagcaataaacatagatatttggcaagatagtgatggaatttggtttactgtttcaaataatggatcaggtattagtttggctaggcaacaagccatacgtacaatgttaagatcaactcactcgcatcatgggcttattaattcttatagacgattacaatatcaattttcaacagtattgttagagtttacgaagacagatgatgcttttcgagttagctatatagtaaaggag

SEQ ID NO: 10198 - protein, 549 aa, Streptococcus agalactiae
MRGYRMEERFKKRLQDDISKHFSRQSLILSLLLIALFVLFSLAPQQIGLYKDVNSVSYSYKQLIQKHDTLLDDLGKNSLKPFVSGHLGSADLSKQYYHLRNHLQSQTELLVFSPNQELLFASNSHLGNFFSKSIYISEVLDKAKINQRLLKIIVDSEGGHYLALIKPIIVNKKVSGYAFLLMNGKDFLLPTKAINSDLIIADQLNNSFTFTNRDFISSSLDKVDSQFLTRYFSFHDHRAFVVRKVALQDNILLYMYRPLIPVTLVVLFSLVSSVIIFVILRQKSRVLADRIAVKNSSAINQMVLDMDAISRQEKSSIELDSQDEFQYLSVQINQMVSRLKDLHEKTLDLETQKLLFEKRMLEAQFNPHFLYNTLETILITSHYDSQLTERIVIQLTKLLRYSLSGSTEAAVLKDDLAIIESYLLINQVRFEELTYTISVSPELEHMRVPKLFLLPLIENAIKYGLKERHDVAINIDIWQDSDGIWFTVSNNGSGISLARQQAIRTMLRSTHSHHGLINSYRRLQYQFSTVLLEFTKTDDAFRVSYIVKE

SEQ ID NO: 10199 - DNA, 846 bp, Streptococcus agalactiae
atgttattacagctagataatatcactaaaagctacgggaaaaaaatagtacttaaccagatttcctaccagtttactcctggtttgtatggactcttaggagcaaatggtactggcaaaacaaccttattaaatttgatgagccactttacattagcagatagtgggaatatttattggaatggacaggagcagtcggaagaattttatcgtcacattggttttttaccgcaacattttcgctattatgatcaatttactggcattgctttcttaaattatatcgctaccttaaaaggtgttgataaaaagaaagctaaacaagaaattcctagattactagagcttgttggtttaggcgatgtaggtaaaaagaagatttcatcatactccggtggtatgaagcaacgtttaggcattgctcaagcacttatcaatgatcctgaaatactcattctggatgaaccaactgttggacttgatcccaaggaacgggttaaatttcgccatattttgagtcagttatccaccaataaaattatcattttatcaacgcatattgtgtcggatgtggaagctgttgccaaagaaattatagtattaaaaaatggtaaatttatcgaacatggcaacaccgcacagctgttgaaaactattgagggaaaagtgtgggaaataacgactgaaccaggtttatctcagatacccaatattgctattgttaatgaaaaagtcttttcagatagtcgggtatttcgtgtagtgagtgatatttgtccgagtgattcggcacagttggttgttccgactctagaagatttctacatctatcattttagaggggag

SEQ ID NO: 10200 - protein, 282 aa, Streptococcus agalactiae
MLLQLDNITKSYGKKIVLNQISYQFTPGLYGLLGANGTGKTTLLNLMSHFTLADSGNIYWNGQEQSEEFYRHIGFLPQHFRYYDQFTGIAFLNYIATLKGVDKKKAKQEIPRLLELVGLGDVGKKKISSYSGGMKQRLGIAQALINDPEILILDEPTVGLDPKERVKFRHILSQLSTNKIIILSTHIVSDVEAVAKEIIVLKNGKFIEHGNTAQLLKTIEGKVWEITTEPGLSQIPNIAIVNEKVFSDSRVFRVVSDICPSDSAQLVVPTLEDFYIYHFRGE

SEQ ID NO: 10201 - DNA, 2181 bp, Streptococcus agalactiae
atgaaaaataatgtcaaacagctctttagttttgaattttggcagaagtttgggaaggctttgatggttgttattgctgttatgccagcagcaggattgatggttagtattggtaactccattagtctattggatccatcaaatgttttattagggcgcatagctaatgttattgctcaaattggttggggagttattggtaacttacacatcttatttgcattggctattggtggtagctgggctaaagaacgtgccggtggtgcttttgcggctggcttatcctttattcttattaaccttattacagggaacttttttggtgttaaaacagatatgttagcagacagtaaagcaactgttcaaacggtatttggtgcaaccatcagagtttcagattactttgttaacgttcttgggcaacctgctcttaatatgggtgtatttgtcggtattatttcaggtttcgttggtgcaactgcctttaataaatattataactatcgtaaattaccagatgctttaacttttttcaatggaaaacgttttgttccatttgttgttatttatcgttcagtcattgttgcattaattttatcagtattttggccggttgttcaatcaggtatcaatggctttggtaaatggattgcaagttcacaagacagtgctccaatattagcaccatttgtctacggtacgttagagcgtttattgctcccatttggtttacaccatatgttaactattccaatgaactacacgcaactaggtggcacatacactgtccttacaggtgcaactaaaggagcacaggtgttgggacaagatccactgtggttagcatgggttggtgatttaattaacttaaaaggctcaaattcaagtcaataccatcacttattgacaagtgtcactccagcacgttttaaagtggggcaaatgattggtgcttcaggtattttgatgggattatcttatgctatgtatcgtaacgttgataaagataaaaaattgaaatacaagtcaatgtttatttcagcagcagcggctactttcttgacaggtgttactgagccaattgagtacatgttcatgtttgcagcaatgccactctaccttgtatatgctgtcgttcaaggatgtgcgtttgctatggcagatattgttaacctccgcgttcattcatttggtaatatagaatttttaacacgtgttcctatgggcataaaagcgggccttggtggtgatattttcaactttgtttgggtgacacttctttttgcagtattgatgtactttattgcaaactttatgattaaaaaattcaatttagcaacagcaggacgtaatggtaattatgataacgaagaggttgataatgctccttcaacagcttctggttctgctgatgcaaattctcaagttgtacaagttattaatttacttggtggtcgtgataacattgaagatgtagatgcatgtatgactcgtcttcgtgtcacagttaaagatggaaatagcgtgggttctgaagcagcttggaaaaaagctggtgcaatgggattggtgttaaaaggtaatggcgttcaagctatttacggacctaaagcagatgtccttaaatcagacattcaagatttgctagattcaggtacagttattccaatagttgatttagaaacaggtcaacctgtagcagcagccccagttacaacttataaaggaataacagaagaaattgtttcggtggctaatggtcaagtagaagcattggatgttgttaaagaccctgtcttttctcaaaaaatgatgggtgatggctttgctgtggaaccaactgatggcaatatttatgttccagtttcaggtacagttactagtgtctttccaacaaaacatgcttttggtttattaacagaaagtggcctagaagttttagtacatatcggtctagatacagtagctcttgatggtcaaccatttgaggttaaaatttctagtggtcaaaaagtggtagcaggcgatcttgctgtagtagcagatttggaagctatcaaagcagctggtaaagagacaagtgtgattatcgtctttacaaatgtttcagatataaaaactgttaaacttgaaaaatcaggtccacaaatagctaaaacagttgtggcaaaagtcgaactg

SEQ ID NO: 10202 - protein, 727 aa, Streptococcus agalactiae
MKNNVKQLFSFEFWQKFGKALMVVIAVMPAAGLMVSIGNSISLLDPSNVLLGRIANVIAQIGWGVIGNLHILFALAIGGSWAKERAGGAFAAGLSFILINLITGNFFGVKTDMLADSKATVQTVFGATIRVSDYFVNVLGQPALNMGVFVGIISGFVGATAFNKYYNYRKLPDALTFFNGKRFVPFVVIYRSVIVALILSVFWPVVQSGINGFGKWIASSQDSAPILAPFVYGTLERLLLPFGLHHMLTIPMNYTQLGGTYTVLTGATKGAQVLGQDPLWLAWVGDLINLKGSNSSQYHHLLTSVTPARFKVGQMIGASGILMGLSYAMYRNVDKDKKLKYKSMFISAAAATFLTGVTEPIEYMFMFAAMPLYLVYAVVQGCAFAMADIVNLRVHSFGNIEFLTRVPMGIKAGLGGDIFNFVWVTLLFAVLMYFIANFMIKKFNLATAGRNGNYDNEEVDNAPSTASGSADANSQVVQVINLLGGRDNIEDVDACMTRLRVTVKDGNSVGSEAAWKKAGAMGLVLKGNGVQAIYGPKADVLKSDIQDLLDSGTVIPIVDLETGQPVAAAPVTTYKGITEEIVSVANGQVEALDVVKDPVFSQKMMGDGFAVEPTDGNIYVPVSGTVTSVFPTKHAFGLLTESGLEVLVHIGLDTVALDGQPFEVKISSGQKVVAGDLAVVADLEAIKAAGKETSVIIVFTNVSDIKTVKLEKSGPQIAKTVVAKVEL

SEQ ID NO: 10203 - DNA, 522 bp, Streptococcus agalactiae
atgttgccgggagatgatggtttgactattttagagcgtttaaggagaaaacatcaaacggaaatgataccagtaatcatgacaactgctaaaggtagtgagtatgataaagttaaagggttagatcttggagcagatgattatctcgtcaaaccttttgggatgatggaaatgatttcacgaataaaagcagtcttgagacgtagccgccaagtagattcaaaagctcatattatcattggaaatttagagattgatccgactaattattgggtcaaaaggggaacggaaaaaatccacttaaccctaaaggaatttgagttattagtattattcttccgtaatcccaatagagtctttacaaggcaagaacttctggataaggtttggggagaacaatttttaggagaaactagaactgtggatgttcacattgggacactgcgaacaaaacttggtgaggatggctatttgattgctacagtaaggggagttggataccgtttggaggaaagacatgac

SEQ ID NO: 10204 - protein, 174 aa, Streptococcus agalactiae
MLPGDDGLTILERLRRKHQTEMIPVIMTTAKGSEYDKVKGLDLGADDYLVKPFGMMEMISRIKAVLRRSRQVDSKAHIIIGNLEIDPTNYWVKRGTEKIHLTLKEFELLVLFFRNPNRVFTRQELLDKVWGEQFLGETRTVDVHIGTLRTKLGEDGYLIATVRGVGYRLEERHD

SEQ ID NO: 10205 - DNA, 747 bp, Streptococcus agalactiae
gtgagtaaattagtaattaataatttagatttgtattatggagaatttcacgctctgaaggatgttaatttagacattgaagaaaaagaaatcacagcctttattggaccttctgggtgcggaaagtctactctcttgaaaagtattaaccgtatgaatgatttggtcaaaaattgcaaaatcacaggggatattactttagaaggcgaggatgtctatagacaattggatattaaccaattgcgtaaaaaggttggaatggtgtttcaaaaacctaatccgtttccaatgagcatttatgataatgttgcttttggtccaagaacgcacggtattcattccaaagcagagttagatgatatcgttgaacgttcccttaaacaggcggctctatgggatgaggttaaagatcgtcttcacaaatctgctctgggtatgtctggcggacagcagcaacgtttgtgtattgcgcgtgctcttgctattgagcctgatgttttacttatggatgaacccacaagtgccttggatcctatttcaacagcaaaaattgaagaattggttatccaactgaagaagaactacactattgttatagtgacacataatatgcaacaagctgttcgtatttctgataaaacagcattctttctgatgggagaagtggttgaatataacaaaacgagccaactcttttcattgccacaagatgagcgtacagaaaactacattacagggagattcgga

SEQ ID NO: 10206 - protein, 249 aa, Streptococcus agalactiae
MSKLVINNLDLYYGEFHALKDVNLDIEEKEITAFIGPSGCGKSTLLKSINRMNDLVKNCKITGDITLEGEDVYRQLDINQLRKKVGMVFQKPNPFPMSIYDNVAFGPRTHGIHSKAELDDIVERSLKQAALWDEVKDRLHKSALGMSGGQQQRLCIARALAIEPDVLLMDEPTSALDPISTAKIEELVIQLKKNYTIVIVTHNMQQAVRISDKTAFFLMGEVVEYNKTSQLFSLPQDERTENYITGRFG

SEQ ID NO: 10207 - DNA, 93 bp, Streptococcus agalactiae
ttgtttctgaatcaacaacatgggattccattccttggtaactttgaaaaagccagagatgaaaaaggctacaatggtcatcagacaagctat

SEQ ID NO: 10208 - protein, 31 aa, Streptococcus agalactiae
MFLNQQHGIPFLGNFEKARDEKGYNGHQTSY

SEQ ID NO: 10209 - DNA, 324 bp, Streptococcus agalactiae
atgcaacaggtttttaatgtgagtgttcctgtaccagatgatgttgttattatttcaaaagaagaatatttaaatttattaagtgataatgaacaaggcaagtggtgggatattgataacttgcaagagttattgggaattggaaggtcaaaattgattaatgatattttgttaaatccagatataaaaaaagaagtagatttatcaattaatccaaatggttttattgtttatccgaaaggtaaaggtagtcgatataaaatattagcaacaaaagctagaaaatattttgaagataattttggttctattttattaaatagt

SEQ ID NO: 10210 - protein, 108 aa, Streptococcus agalactiae
MQQVFNVSVPVPDDVVIISKEEYLNLLSDNEQGKWWDIDNLQELLGIGRSKLINDILLNPDIKKEVDLSINPNGFIVYPKGKGSRYKILATKARKYFEDNFGSILLNS

SEQ ID NO: 10211 - DNA, 264 bp, Streptococcus agalactiae
atggaggctattgtttattcacattttagaaataatttaaaagattatatgaagaaggtcaatgatgaatttgagcctttgattgtagttaataaaaatcctgatgaaaatatagtggttttatctcaagatagctgggaaagtttacaagaaacgattcgtttgatggaaaatgattatctatcacataaggttattaatggtatatcacaagttaaagagaagcaagtcactaaacatggtttaattgaggtagaagatgtt

SEQ ID NO: 10212 - protein, 88 aa, Streptococcus agalactiae
MEAIVYSHFRNNLKDYMKKVNDEFEPLIVVNKNPDENIVVLSQDSWESLQETIRLMENDYLSHKVINGISQVKEKQVTKHGLIEVEDV

SEQ ID NO: 10213 - DNA, 480 bp, Streptococcus agalactiae
atggatgttagtgcaattgttagagatataaaaactggtagagctacgttagtttgttttcctgtggaaatgagtgagcttaagttagctttggggcttcgtgaagaagatgatttagagtatattattgcagattcggattgtcagttactaaaagaacatgattctattgagatgattaatcaatttgttgaactggtagagaatgttgatagtgaacttgttaaagcagtgcatcaggtaataggttatactgcctcagactttgtggattatgattttaattttggtgattgttgtttactgtctgatgtcacaactagacgagaactaggtgaatattatttcgatgaattaggcgtacaaggagttggtaaagaggctctggagatgtattttgatcatgaagcttatggtcgagatattgacttagaaagccaaggtggtttttcagactacggatatgtcgaaatatcaggg

SEQ ID NO: 10214 - protein, 160 aa, Streptococcus agalactiae
MDVSAIVRDIKTGRATLVCFPVEMSELKLALGLREEDDLEYIIADSDCQLLKEHDSIEMINQFVELVENVDSELVKAVHQVIGYTASDFVDYDFNFGDCCLLSDVTTRRELGEYYFDELGVQGVGKEALEMYFDHEAYGRDIDLESQGGFSDYGYVEISG

SEQ ID NO: 10215 - DNA, 1347 bp, Streptococcus agalactiae
atgtttagtaaaatagaatttaaaaactttatgtccttttcaaatttgacttttgatttgctgaatagaggaaaatgtaaggatattattgcaatctatggagaaaacggttcaggaaaaacaaatattgttgaagcttttaagttactagttttgtcattacaatcaatggaatccttaaatgaaaatacacgattacaatcattattaaaagaacaaacaaataaagaagaaaatcaaaaaactaactttggtgatatatcagaaatcttagataaaatcagtttcttcaccacttttaagggcatagcgaaaaatactcatagaattgcatctgaaggtaatacgattctaaaatattattttaatatcgaaaaagataatggttattaccttctagaatataatgaaaataatgaactagtaaaagaggagctagtatttaagataaaatccaataagggagttcatttcagtattactaacatagatggtttatctcaatcattaaataagacaatttttaagaatactatttttaaagatttgactgaacaaatagaaaaatattggggtaaacatacattcctatcaatatttaataattattgtctagaagtaaatgaagagtttattaatgaacaagtttctataaattttcaaaaagtagttgatgaatttgataaaatttttatttggagtggtaattttagaggtccttttcattcgacagaattattattgaaagatatttcaaaaggtaaaattgataagtcggaaaaagaaaaactttcctatactgaggaaattatttataaatattttagtgcattatatattgatataaaagatgttaaatataagcaggatgctcaaggtcaagaaataaaatatgaactcatgatccgaaaaaatattggaggtgatcttttagatgtaccaataagtttagaatctcagggaacaaaaaatcttctggatcttctaaaagtttttaacaatgtgttggatgggaaaatatgtatcgttgatgaaattgactcaggtattcatgatcttttaatgaatagtattctgaatgacttgaaaggaagtgtgaatggtcagttaatatttacaacgcatgatacaacgttattgaaggaattatcaccgagctcagcttattttttaaatgtagatattaaaggtaataaagttatcatttctggcaatgaggcagataaaaaaataggagtaaataacaatttagaaaaattatatttgtctggtttctttggtgctgtaccagatccattagatattgatttttcagatttatttcttgatcataatttaagcgaggac

SEQ ID NO: 10216 - protein, 449 aa, Streptococcus agalactiae
MFSKIEFKNFMSFSNLTFDLLNRGKCKDIIAIYGENGSGKTNIVEAFKLLVLSLQSMESLNENTRLQSLLKEQTNKEENQKTNFGDISEILDKISFFTTFKGIAKNTHRIASEGNTILKYYFNIEKDNGYYLLEYNENNELVKEELVFKIKSNKGVHFSITNIDGLSQSLNKTIFKNTIFKDLTEQIEKYWGKHTFLSIFNNYCLEVNEEFINEQVSINFQKVVDEFDKIFIWSGNFRGPFHSTELLLKDISKGKIDKSEKEKLSYTEEIIYKYFSALYIDIKDVKYKQDAQGQEIKYELMIRKNIGGDLLDVPISLESQGTKNLLDLLKVFNNVLDGKICIVDEIDSGIHDLLMNSILNDLKGSVNGQLIFTTHDTTLLKELSPSSAYFLNVDIKGNKVIISGNEADKKIGVNNNLEKLYLSGFFGAVPDPLDIDFSDLFLDHNLSED

SEQ ID NO: 10217 - DNA, 1230 bp, Streptococcus agalactiae
gtggatgctatctatttaaaaaaatttcgaaagaaaacaggtctaaaacaaaaggaatttgctttaagttctggtttgacattgaaatcacttagaaactatgagcaaggaaagcggaagttgacacttgaaaagtatcaagagataaaatcacattttggatatctagtagaaaatgatagttcacgattacaagtgatgattgactatgtcagaattacgttaaaggatgttagggatcttgaatttttctgtcgtaactttttgcactgtgcatttaaagaatttcagccttttgaatcgaagttgatgaattacaatcatctttggaaacgtggagatatttggatatttgattttgcggataaacatgagacaggtaattttcaaataactgttcaattgtctggtcgtggatgccgacaattggaattgttgatggaaactgaaaaatttacatggcatgattggttaagttatctaagaaattcatatcgtgatgatatgaatgtgacacgttttgatattgctattgatgaattgtatctgggtaaggatagagaaaatgaacagtttcatttgtcagatatgatttcaaaatattatcgtcatgagttagattttgaaagtttgagaacttggaattatataggtggcggttctttaaatttttcggatatggaagagattgagcagaatagacaaggaatatcgctttattttggtagtcgtcaatcagaaatgtattttaacttttatgaaaaacgttatgaaattgcaaagcaggaaggaattactgttgaagaagctttagaaatttttgaattgtggaatcgttatgagatacggttatctcaaagtaaagctaatgcggcagttgatgaatttatttctggagtgccgattggtgaaatatccagagggttaattgttagtaagattgacgtgtatgatgggaaaaatgaatatgggtcgtttcaagcagatagaaagtggcaattaatgtttggaggtgttgagcctttaaaatttgttacaaagccagaggcttatagtattgaacgaaccttacgttggttaagtgattctgtttctccgtctttagctatgataagagagtatgacatgattgtggatggtgactatttacaaaccattcttaattctggggaagtcaatgaacgtggggagaagatacttgacagtatcaaagctagcttaggtattttg

SEQ ID NO: 10218 - protein, 410 aa, Streptococcus agalactiae
MDAIYLKKFRKKTGLKQKEFALSSGLTLKSLRNYEQGKRKLTLEKYQEIKSHFGYLVENDSSRLQVMIDYVRITLKDVRDLEFFCRNFLHCAFKEFQPFESKLMNYNHLWKRGDIWIFDFADKHETGNFQITVQLSGRGCRQLELLMETEKFTWHDWLSYLRNSYRDDMNVTRFDIAIDELYLGKDRENEQFHLSDMISKYYRHELDFESLRTWNYIGGGSLNFSDMEEIEQNRQGISLYFGSRQSEMYFNFYEKRYEIAKQEGITVEEALEIFELWNRYEIRLSQSKANAAVDEFISGVPIGEISRGLIVSKIDVYDGKNEYGSFQADRKWQLMFGGVEPLKFVTKPEAYSIERTLRWLSDSVSPSLAMIREYDMIVDGDYLQTILNSGEVNERGEKILDSIKASLGIL

SEQ ID NO: 10219 - DNA, 294 bp, Streptococcus agalactiae
atgaaacaagaaacattagtgttacttccaaattttattggagatgcaatttatgaaggatttgaagctggacctgctcaattaaatggtaaaaaagggtcttatacaagacacattttgtttaatgaaaaacatggtaagttttatgtttatacaccagcatcttcacgtgtgattggaaatggaaaaatggtaactgttgaaaaaccgttattgtttattgacaatacaattaatggtagaaatattgaacctgcaaaaaatgtatgggctgaaaagcttattgaagtgaaa

SEQ ID NO: 10220 - protein, 98 aa, Streptococcus agalactiae
MKQETLVLLPNFIGDAIYEGFEAGPAQLNGKKGSYTRHILFNEKHGKFYVYTPASSRVIGNGKMVTVEKPLLFIDNTINGRNIEPAKNVWAEKLIEVK

SEQ ID NO: 10221 - DNA, 1251 bp, Streptococcus agalactiae
atgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagac

SEQ ID NO: 10222 - protein, 417 aa, Streptococcus agalactiae
MSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITD

SEQ ID NO: 10223 - DNA, 333 bp, Streptococcus agalactiae
atgaaaaggaataaacatttaccgttaacagaaactacctattatatcttattagctttgtttgaggaagcacatggctatgctattatgcaaaaagttgaagaaatgagtggcggtgatgttagaatagccgcagggacaatgtacggtgccattgaaaatttacttaaacaaaaatggataaagtctatcccaagtgacgatagaagaagaaaagtttatattattactgagacaggaaaagaaatagtagaacttgaaacgaatcgattaagaaagttacttaatactgctaatcagttgggttttgggggagatagttatgataaagtt

SEQ ID NO: 10224 - protein, 111 aa, Streptococcus agalactiae
MKRNKHLPLTETTYYILLALFEEAHGYAIMQKVEEMSGGDVRIAAGTMYGAIENLLKQKWIKSIPSDDRRRKVYIITETGKEIVELETNRLRKLLNTANQLGFGGDSYDKV

SEQ ID NO: 10225 - DNA, 486 bp, Streptococcus agalactiae
atggaaattaaagaatacgagaataatccgtaccatttagcacagctagtagatttaattaattattgtcagaatatagaagctaaacttgatataaagatggctgaacaagacgatatttttcaaatagaaaattattatcaaaacagaaaaggtcaattttggattgccttagaaaatgaaaaagtagttggttcgattgcgttactgcgtattgatgataaaacagctgttctaaaaaaattttttacatatccaaaatatagaggaaatcctgttcgacttggtcgaaaattatttgaaagatttatgctttttgctcgagctagtaaattcacaagaattgtcttggatactccagaaaaagagaaaagatctcacttcttttatgaaaatcaaggatttaagcaaataacaagagatgaactagatgtagactacatttttccagatagagattcaaggatatatgtaaaacttcttgat

SEQ ID NO: 10226 - protein, 162 aa, Streptococcus agalactiae
MEIKEYENNPYHLAQLVDLINYCQNIEAKLDIKMAEQDDIFQIENYYQNRKGQFWIALENEKVVGSIALLRIDDKTAVLKKFFTYPKYRGNPVRLGRKLFERFMLFARASKFTRIVLDTPEKEKRSHFFYENQGFKQITRDELDVDYIFPDRDSRIYVKLLD

SEQ ID NO: 10227 - DNA, 741 bp, Streptococcus agalactiae
atgttaaaaaaagaatggatggagaatgttaggacatacaaagttatatctattctgattacttgttcaatatttggtatattaggtcccttaactgcacttatgatgcctgatattatggcaggaattttacctaaaaaactacagggagcgataccagagcctacctatattgattcttatattcagtattttaaaaatatgaatcagcttggtttagttattttagtatttttatttagtagtacactgacgcaagaattttcaaaaggaaccttaattaatctagttacgaagggattagccaaaaaagttataatccttgctaaatttatagtaattacccttctatggacagtgtcatacttattaagtgttgtcatccattttagttatacgttatattactttagtaacgaaggaagtcataaattaatggtttacggtgcaacatggtttatcggtattcttttcataagcttaatactctttttttcagttctttttcgtaaaactttagggggtttgttaggttgtctttttatggtggtgttatgtgtagtatctggattttttaaaatcagtaaaagctataatcctatgcttcttatccaaaaacaaggagaaatattaagtggaaagtttaaagttcaagacttaatggaaccgagcatattagtgtttttgcttattataatgacgttattacttagcatgtacatttttgaaaaaagtgaagtt

SEQ ID NO: 10228 - protein, 247 aa, Streptococcus agalactiae
MLKKEWMENVRTYKVISILITCSIFGILGPLTALMMPDIMAGILPKKLQGAIPEPTYIDSYIQYFKNMNQLGLVILVFLFSSTLTQEFSKGTLINLVTKGLAKKVIILAKFIVITLLWTVSYLLSVVIHFSYTLYYFSNEGSHKLMVYGATWFIGILFISLILFFSVLFRKTLGGLLGCLFMVVLCVVSGFFKISKSYNPMLLIQKQGEILSGKFKVQDLMEPSILVFLLIIMTLLLSMYIFEKSEV

SEQ ID NO: 10229 - DNA, 813 bp, Streptococcus agalactiae
atgatttatggattcgtaggaccaaatggagcaggtaaaacaacgacaataaaaatgattttaggattgttaaaatttgatacgggtttcataacaatttttggtaaaaaagttaattttggaagaacagataccaatcaactgattggctatctcccagatgttcccgagtactacgattatatgacagctctagaatatcttgatttatgttctggtttagcgagatcaaagcataagctttctaacaaagaactacttaggtcagttggacttgacgataatcaccaaaagattgctacttattctcgaggaatgaaacagcgtcttggattagcccaagcactggttcatgatcctaaaattattatttgcgatgaaccaacctctgcattagacccgaaaggtcgccaagatattttagatattatttcaaatcttagaggagaaaaaactgtgattttttctacccatattctctctgatgtcgaaaaaatatgtgatcatgttctggtgttaactaagtgtgggatttattctcttgaagagttaaaaggaaaaaaatcagaggaaaattattcggttcgtattttaataaaagtgacaaagtctgaagctaaggtactatctcataactatcagatagaaaagaaagataatgagtatgcactgactctcaaaggctctaaaatggataacaaagcagatttactagctggtttttaccaagatttagtttctttaaagattagcccatcagctattgaagtcattgacaatagtttagaggagctttatttggaggttaccaaa

SEQ ID NO: 10230 - protein, 271 aa, Streptococcus agalactiae
MIYGFVGPNGAGKTTTIKMILGLLKFDTGFITIFGKKVNFGRTDTNQLIGYLPDVPEYYDYMTALEYLDLCSGLARSKHKLSNKELLRSVGLDDNHQKIATYSRGMKQRLGLAQALVHDPKIIICDEPTSALDPKGRQDILDIISNLRGEKTVIFSTHILSDVEKICDHVLVLTKCGIYSLEELKGKKSEENYSVRILIKVTKSEAKVLSHNYQIEKKDNEYALTLKGSKMDNKADLLAGFYQDLVSLKISPSAIEVIDNSLEELYLEVTK

SEQ ID NO: 10231 - DNA, 705 bp, Streptococcus agalactiae
atggtatgtgtcgattttattgatcaaaaagtttatagtgaagcagaaggcctatttgtttccgatttagacttaggcattaaaggtttaataagagcacgttatccttttgctctggatagtgactttatttcgtatggaaatttaagtcattattgtatgaattatcttgacgaaattgttcagcgagcgaatcagaaaaatgagaagataaaatataatgtgactaccttgatgaaagaagaagagaagcccttcaacgttgaagagcgtttgaacaagcaagcaactatcggtcaacgaattgctgatgatgttgcacgttttggcggatcttggacttttattatcgtttttgtatccattatggctatttggatgttggttaatatcatgaagccttttggtattcaatttgatccttacccatttatcctgttaaacttagctttatcaacgattgctgcaatccaagcaccacttattatgatgagtcaaaatcgtgctgctgattatgatcgtttgcaagctcgaaatgactttaatgtcaataaaacctctgagttagaaattagattattgcacgaaaagattgatcatatggtacaacaagatcagtttgaattgttagagattcaaaagttacagacagaaatgctagtatcattgggaaatcagttagcacaattgaaacaactacaaaaa

SEQ ID NO: 10232 - protein, 235 aa, Streptococcus agalactiae
MVCVDFIDQKVYSEAEGLFVSDLDLGIKGLIRARYPFALDSDFISYGNLSHYCMNYLDEIVQRANQKNEKIKYNVTTLMKEEEKPFNVEERLNKQATIGQRIADDVARFGGSWTFIIVFVSIMAIWMLVNIMKPFGIQFDPYPFILLNLALSTIAAIQAPLIMMSQNRAADYDRLQARNDFNVNKTSELEIRLLHEKIDHMVQQDQFELLEIQKLQTEMLVSLGNQLAQLKQLQK

SEQ ID NO: 10233 - DNA, 2235 bp, Streptococcus agalactiae
atggtaaaagtttcaaatttagggtatccacgtcttggtgaacagcgcgaatggaagcaagcgatcgaagctttctgggcagggaatcttgaacaaaaagatttagaaaaacaactaaaacaattacgtatcaatcatttaaagaaacaaaaagaggcaggtattgaccttattccagtgggggatttttcttgttatgatcatgttttggatttgtcatttcaattcaatgtaatcccaaagcgtttcgatgagtatgagaggaatttagacctttattttgctattgcaagaggtgataaagataatgtcgcatcatctatgaaaaagtggtttaataccaactaccactacatagtcccagaatgggaggttgagactaaacctcacttgcagaataattacttacttgatctttatctagaagctagggaagtagttggtgataaagcaaagccggttatcactggtccaataacctatgtttccttatcatcaggaattgtcgactttgaagcgactgttcagcggttattaccactttataagcaggtctttcaagatctgatagatgcaggcgccacctatattcagattgatgagccgatatttgtaactgatgaaggtgaacttttagtagatatagctaagtctgtttatgatttttttgcaagagaagtaccacaagcccacttcatctttcaaacctactttgaatcagcagtctgtttagataaactctctaagctgccagtaacgggatttggccttgattttatacatggtagggcggaaaatttagctgctgttaagcaaggtctattccgcgaaaaagaattatttgcaggaattgttaatggtcgaaatatctgggcagtaaatttagaagaaacgttggctttattggaagagataggtccctttgttaaacgattgactcttcaaccttcttcaagtcttttacatgtaccggtgacgactaaatacgaaacacatttagaccctgtgttaaagaatggcttatcatttgctgatgaaaaactaaaggaattagaactattagctagtgcttttgatggtaataaaacaaagggatatcacgaagctttatctcgtttttcagctcttcaagctgctgattttcgtcatgtagcattggaatcattagcagaagtaaagcttgaacgaagtccgtataaattacgccaagctttgcaagctgaaaaattacagttaccgattttaccaacaacaactattggatcctttcctcaatcacctgaaattaggaagaaacgccttgcttggaaaagaggaaatctatctgactcagattataaagatttcataaaaactgaaattagaagatggattgctattcaagaagatcttgatcttgatgtgttagtacatggcgaatttgagcgtgttgatatggttgaattttttggtcaaaagttagctggttttacgacaaccaaattaggctgggtacagtcttatggttcaagggcggtcaaaccacctatcatttatggtgatgtcaaacatattcaacccttaagccttgaagaaacggtttatgcccaaagtttgactaagaaacctgttaaaggcatgttgacaggtcctattactataacgaactggtcatttgagcgagatgatattagccgatctgatctttttaatcaaattgctttggctataaaagatgagattcaacttttggaacaatcaggtattgctattatacaagtggatgaagcagcccttcgagaaggtttacccttacgccagcaaaagcaacaggcttacttagatgatgctgttgcggcctttaaaattgcaacttcatctgtgaaagatgagacacaaattcatacacatatgtgttattcaaaatttgacgaaattattgattctatccgtgcactagatgcagatgttatttctattgaaacgagtagaagtcatggggacatcattgaaagttttgaaacagcagtttatcctctaggaattggcctgggtgtttatgatattcattcccctcgcatacctactaaggaagaaattattgtcaatattcaacgatcactaaaatgtctatcaaaagagcaattttgggtaaaccctgattgtggcttaaaaacacgccgtgaagcagaaacaattgctgccttggaggttcttgtttcagctaccaaagaggttcgtcagcaattagataat

SEQ ID NO: 10234 - protein, 745 aa, Streptococcus agalactiae
MVKVSNLGYPRLGEQREWKQAIEAFWAGNLEQKDLEKQLKQLRINHLKKQKEAGIDLIPVGDFSCYDHVLDLSFQFNVIPKRFDEYERNLDLYFAIARGDKDNVASSMKKWFNTNYHYIVPEWEVETKPHLQNNYLLDLYLEAREVVGDKAKPVITGPITYVSLSSGIVDFEATVQRLLPLYKQVFQDLIDAGATYIQIDEPIFVTDEGELLVDIAKSVYDFFAREVPQAHFIFQTYFESAVCLDKLSKLPVTGFGLDFIHGRAENLAAVKQGLFREKELFAGIVNGRNIWAVNLEETLALLEEIGPFVKRLTLQPSSSLLHVPVTTKYETHLDPVLKNGLSFADEKLKELELLASAFDGNKTKGYHEALSRFSALQAADFRHVALESLAEVKLERSPYKLRQALQAEKLQLPILPTTTIGSFPQSPEIRKKRLAWKRGNLSDSDYKDFIKTEIRRWIAIQEDLDLDVLVHGEFERVDMVEFFGQKLAGFTTTKLGWVQSYGSRAVKPPIIYGDVKHIQPLSLEETVYAQSLTKKPVKGMLTGPITITNWSFERDDISRSDLFNQIALAIKDEIQLLEQSGIAIIQVDEAALREGLPLRQQKQQAYLDDAVAAFKIATSSVKDETQIHTHMCYSKFDEIIDSIRALDADVISIETSRSHGDIIESFETAVYPLGIGLGVYDIHSPRIPTKEEIIVNIQRSLKCLSKEQFWVNPDCGLKTRREAETIAALEVLVSATKEVRQQLDN

SEQ ID NO: 10235 - DNA, 690 bp, Streptococcus agalactiae
atggaaaaaggatttaaagagggagtgaaagatgccttgcccacagctttagggtatatctcaataggcttggcgtttgggatagttgcttcagcatcagatttatctgcaatagaagttggtcttatgagtgccttggtatatgggggatctgctcagtttgctatgtgtgcgctattattagcaaaagcagacttgatgactattacgatgacagtatttttagttaatttgagaaatatgttaatgagtttacacgcgactactatcttcaagtctgctcacctaatgaatcaattagccataggaactctaataacagatgagagctacggcgttttacttggagaagcattacatcacaaagttgtatcgcctagttggatgcatggtaataatgtgatgagttatttgacatgggtaatctcaacgataataggaactttactggggagtactattcctaatccagaaatgtttggtttagactttgcattagtcgccatgtttataggtctctttgtatttcagttgtttgggatgttatctgatggaaagcgacttgttgtatatgttcttgcttctgtaggtttaagttacttcttattagctacttttttgtcaggagccttatcagtattgcttgcgactgttgttggatgtagtgtgggagttgttttagatgataaa

SEQ ID NO: 10236 - protein, 230 aa, Streptococcus agalactiae
MEKGFKEGVKDALPTALGYISIGLAFGIVASASDLSAIEVGLMSALVYGGSAQFAMCALLLAKADLMTITMTVFLVNLRNMLMSLHATTIFKSAHLMNQLAIGTLITDESYGVLLGEALHHKVVSPSWMHGNNVMSYLTWVISTIIGTLLGSTIPNPEMFGLDFALVAMFIGLFVFQLFGMLSDGKRLVVYVLASVGLSYFLLATFLSGALSVLLATVVGCSVGVVLDDK

SEQ ID NO: 10237 - DNA, 4710 bp, Streptococcus agalactiae
atgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 10238 - protein, 1570 aa, Streptococcus agalactiae; identical to SEQ ID NO: 8964

SEQ ID NO: 10239 - DNA, 684 bp, Streptococcus agalactiae
atgacaaaaataatttatttcgctgatgatgaaaagaatattcgtgacttggtggttccttttttagaacatgatggtttcactgttcgagcatttgaaactggagaccttctcttagaagcctataaaaaccaaaaacccgatttagttatattagacataatgatgcctggaactaatggtttagatgttatgaaaagcatccgccaatatgataatattcctattatcatgttaacagctagagattctgatgttgatttcattacggcttttaatttaggaactgacgattacttcaccaagcctttttcacctataaaacttagtctacatgttaaagcattgttcaaacgccttgatgaaaaagcaatcaaaaatgacactcagtatcagttcctagatttaactctggataccgaaaagcgaatagccctattatcaaatgaagaaatgcccttaaccaagacagaatttgattttcttttagtattaattgaaaaacctgaaactgctttttctagggaaacactgcttaatcgtatttggggatttgatgatattgaaagcagagcagttgatgacactattaaacgattacgtaaaaaatttaagcaataccacagtcaggttagtatcaaaactgtctggggttacggcttcaaattaatcaaagaggacaaa

SEQ ID NO: 10240 - protein, 228 aa, Streptococcus agalactiae
MTKIIYFADDEKNIRDLVVPFLEHDGFTVRAFETGDLLLEAYKNQKPDLVILDIMMPGTNGLDVMKSIRQYDNIPIIMLTARDSDVDFITAFNLGTDDYFTKPFSPIKLSLHVKALFKRLDEKAIKNDTQYQFLDLTLDTEKRIALLSNEEMPLTKTEFDFLLVLIEKPETAFSRETLLNRIWGFDDIESRAVDDTIKRLRKKFKQYHSQVSIKTVWGYGFKLIKEDK

SEQ ID NO: 10241 - DNA, 2499 bp, Streptococcus agalactiae
atgacattctataatcacaaagaaatcgaacccaaatggcaagctttttgggcagataatcatacctttaaaacaggaacagacgcatcaaaacctaagttttatgccctagatatgttcccatacccatctggagctggtctccacgttggtcacccagaaggctatacagcaacggatattctcagccgtttcaaacgtgcccaaggtcacaatgtcctccacccaatgggttgggatgcttttggacttcctgctgagcagtacgctatggatactggtaatgacccagctgagtttacagctgaaaacatcgctaacttcaaacgccagattaatgctcttggtttctcatacgactgggatcgtgaagttaacacaactgaccctaactactacaagtggacacagtggatctttaccaagctttatgaaaaaggtctagcttacgaagctgaagttccagttaactgggttgaagaattgggaacagctatcgccaacgaagaggttcttccagatggtacatcagaacgtggtggctacccagttgtcagaaaaccaatgcgccaatggatgctcaaaatcactgcctatgcagagcgcttgctggaagacttggaagaagttgactggccagagtcaatcaaggacatgcaacgcaactggattggtaaatcaactggtgctaatgtaaccttcaaggttaaggatacagataaggacttcactgtctttacaacacgtcctgacaccctttttggtgcgacttacgcagttcttgctcctgagcatgccttggttgatgctattacaacagctgaccaagcagaagccgttgccgaatacaaacgtcaagcgagtctcaaatcagaccttgctcgtacagaccttgccaaagaaaaaactggtgtctggacaggtgcctatgccattaacccagttaatggtaaagaaattccagtttggattgcggactatgtccttgctagctacggtacaggtgctatcatggcagttccagctcacgatgaacgtgactgggaattcgcaaaacaattcaacctagacatcattccagttcttgaaggtgggaatgttgaagaggctgcctttacagaagacggtcttcacatcaactcagacttcctagatggtctcgacaaagcggcagctattgccaaaatggtcgagtggcttgaagcagaaggtgttggtaatgagaaagttacttaccgtcttcgtgactggctcttcagccgtcagcgttactggggtgagccaatcccaatcatccactgggaagatggaacatcaactgcggttcctgagagcgaattgccactagttcttccagttactaaggatatccgtccttcaggtactggtgagagcccacttgctaacttgacagactggttggaagtcactcgtgaagatggcgttaaaggtcgtcgtgagaccaacaccatgccacaatgggcaggttcaagctggtactatctccgctacatcgatccacacaacactgaaaaactagctgacgaggaactcctcaaacaatggttgccagttgatatctatgtcggtggtgcagagcatgccgtgcttcaccttctctatgctcgcttctggcacaaggttctttatgatctcggtgtcgtacctaccaaagagccattccaaaaactctttaaccaagggatgattttgggaacaagctaccgcgacagccgtggtgctcttgtggcaactgacaaggttgaaaaacgtgatggcagcttcttccatgtggaaactggtgaagagcttgaacaagcacctgctaagatgtctaaatcacttaagaacgttgtcaatccagatgatgttgttgagcagtacggtgctgacacccttcgtgtttacgagatgttcatgggaccactcgatgcttcaatcgcttggtctgaagaaggtcttgaaggctcacgtaagttcttggaccgtgtttaccgtttgatcacgactaaagagatcactgaggaaaatagcggagctcttgacaaggtttacaacgaaactgttaaggcagttactgagcaagttgaccaaatgaaattcaacacagctatcgctcaactcatggtctttgtcaatgcagccaacaaggaagacaaactctttagcgactatgccaaaggctttgttcaattgattgcaccattcgcaccgcacttaggtgaagaactctggcaagtcttgacagcctcaggacagtcaatctcttacgtgccatggccaagctatgacgaaagcaaattggttgaaaacgaaatcgaaatcgttgtccaaatcaaaggtaaggtcaaagctaaactcgtcgttgctaaagacctttcacgcgaagaattgcaagatcttgctcttgctaacgaaaaagtccaagccgaaatcgcaggcaaagacatcatcaaagtcatcgcagtaccaaacaaactcgttaatattgtggtgaaa

SEQ ID NO: 10242 - protein, 833 aa, Streptococcus agalactiae
MTFYNHKEIEPKWQAFWADNHTFKTGTDASKPKFYALDMFPYPSGAGLHVGHPEGYTATDILSRFKRAQGHNVLHPMGWDAFGLPAEQYAMDTGNDPAEFTAENIANFKRQINALGFSYDWDREVNTTDPNYYKWTQWIFTKLYEKGLAYEAEVPVNWVEELGTAIANEEVLPDGTSERGGYPVVRKPMRQWMLKITAYAERLLEDLEEVDWPESIKDMQRNWIGKSTGANVTFKVKDTDKDFTVFTTRPDTLFGATYAVLAPEHALVDAITTADQAEAVAEYKRQASLKSDLARTDLAKEKTGVWTGAYAINPVNGKEIPVWIADYVLASYGTGAIMAVPAHDERDWEFAKQFNLDIIPVLEGGNVEEAAFTEDGLHINSDFLDGLDKAAAIAKMVEWLEAEGVGNEKVTYRLRDWLFSRQRYWGEPIPIIHWEDGTSTAVPESELPLVLPVTKDIRPSGTGESPLANLTDWLEVTREDGVKGRRETNTMPQWAGSSWYYLRYIDPHNTEKLADEELLKQWLPVDIYVGGAEHAVLHLLYARFWHKVLYDLGVVPTKEPFQKLFNQGMILGTSYRDSRGALVATDKVEKRDGSFFHVETGEELEQAPAKMSKSLKNVVNPDDVVEQYGADTLRVYEMFMGPLDASIAWSEEGLEGSRKFLDRVYRLITTKEITEENSGALDKVYNETVKAVTEQVDQMKFNTAIAQLMVFVNAANKEDKLFSDYAKGFVQLIAPFAPHLGEELWQVLTASGQSISYVPWPSYDESKLVENEIEIVVQIKGKVKAKLVVAKDLSREELQDLALANEKVQAEIAGKDIIKVIAVPNKLVNIVVK

SEQ ID NO: 10243 - DNA, 807 bp, Streptococcus agalactiae
atgagaggtctttatactgctggagttttagatgcttttctagatgcaggaataaaaatagatggtatcgtatctgtctctgctggtgcattgtttggtgttaattttgtatctagacaacgagagagggctttgcgatacaataaaaagtatttatcccaccctaaatatatgagtctaaggtcatggtttcgaacagggaattttgttaataaagatttcacctattatgaagttcctatgaaattggatgtatttgacgatgaagcatttaaaaaatcaagtattgatttttacgtagttgctacagagatgacatctggtaaacctgaatattttaaaattgatagtgtttttgaacaaatggaaattttacgtgctagttcagcattaccagtagtctcaaagatggttgattggcaggggaaaaagtacttagatggtggtttatctgatagtattcccgttgattttgcccgtggtttaggatttgacaagttgattgttgtgatgactaggccgctcaattatcagaaaaagccttcaagtggacgattgtataaaactctgtataggaaatatcctaattttgtaaagacagcctcgaatcggtaccaacagtataataatagtcttgaaaaggtcatgagccttgaaaaaacaggcgatctatttgcaattagaccgagtaagagcttggttattggccgcttagagaagaatccggataaacttgatagtatttatcagcttggtatgaaagatgctaaaagtgtgatgcctgagctgaatagttatctaatgaaa

SEQ ID NO: 10244 - protein, 269 aa, Streptococcus agalactiae
MRGLYTAGVLDAFLDAGIKIDGIVSVSAGALFGVNFVSRQRERALRYNKKYLSHPKYMSLRSWFRTGNFVNKDFTYYEVPMKLDVFDDEAFKKSSIDFYVVATEMTSGKPEYFKIDSVFEQMEILRASSALPVVSKMVDWQGKKYLDGGLSDSIPVDFARGLGFDKLIVVMTRPLNYQKKPSSGRLYKTLYRKYPNFVKTASNRYQQYNNSLEKVMSLEKTGDLFAIRPSKSLVIGRLEKNPDKLDSIYQLGMKDAKSVMPELNSYLMK

SEQ ID NO: 10245 - DNA, 1200 bp, Streptococcus agalactiae
atgcaatttatttatagtattattggtattttattggtattaggaattgtgtatgcaatttctttcaatcgtaagagtgtttctctaagtttaattggaaaagctcttatcgttcaattcattattgcgctaatcttagtacgtatcccactaggtcaacaagttgttagtgttgtttcaactggagttactaaagtaatcaactgtggtcaagctggattaaattttgtgtttggttcattagcagatagtggagcaaaaactggttttattttcgccattcaaacgcttggcaatattgttttcttatctgccctagttagtctactttattatgtaggaatccttggatttgtagtaaaatggataggtaagggcgttggtaaaattatgaaatcctcagaggttgagagttttgttgccgtagctaatatgtttcttggtcaaacagacagtccaattttggttagcaaatacctaggtcgtatgactgatagtgagataatggttgtgttggtatcaggtatgggaagtatgtcagtttctattcttggtggctacattgcattaggcattccaatggaatatctcttgattgcttcaacaatggttcctattggcagtattctcattgctaaaatcttattgcctcaaacagaacctgttcaaaaaattgatgacattaagatggataataaaggtaataacgccaatgtgattgatgcaatcgctgagggtgcaagcacaggtgcacaaatggctttctcaattggtgctagtttgattgcctttgttggtttagtttctttgattaatatgatgttaagtggattgggaatccgcttagaacaaatcttctcatatgtttttgctccatttggttttcttatgggatttgaccacaaaaacattcttctagaaggaaaccttcttggaagtaagttgattttaaatgagtttgtttcgttccaacaattgggtgacctaatcaaatctttagattatcgtacagcattggtagcaactatttcactttgtggttttgctaatttatcaagtttaggtatttgtgtttcaggtattgctgttctttgtccagagaaacgtggcaccctagctcgacttgttttccgtgcaatgattggtggtattgctgtaagtatgcttagcgcctttatcgtcggtattgtaactctattc

SEQ ID NO: 10246 - protein, 400 aa, Streptococcus agalactiae
MQFIYSIIGILLVLGIVYAISFNRKSVSLSLIGKALIVQFIIALILVRIPLGQQVVSVVSTGVTKVINCGQAGLNFVFGSLADSGAKTGFIFAIQTLGNIVFLSALVSLLYYVGILGFVVKWIGKGVGKIMKSSEVESFVAVANMFLGQTDSPILVSKYLGRMTDSEIMVVLVSGMGSMSVSILGGYIALGIPMEYLLIASTMVPIGSILIAKILLPQTEPVQKIDDIKMDNKGNNANVIDAIAEGASTGAQMAFSIGASLIAFVGLVSLINMMLSGLGIRLEQIFSYVFAPFGFLMGFDHKNILLEGNLLGSKLILNEFVSFQQLGDLIKSLDYRTALVATISLCGFANLSSLGICVSGIAVLCPEKRGTLARLVFRAMIGGIAVSMLSAFIVGIVTLF

SEQ ID NO: 10247 - DNA, 735 bp, Streptococcus agalactiae
atgcctaaaaatgaactaaataataaactaaataaactaaagcatgtacaagtctacaataagatttttaacatgattcaagacggtacttattctcctggaatgcaattaccttctgaacccgaattagcagggcaacttaatgttagtcgagctactttacgaaagtcattagcactattacaagaagaccatttggttaaaaatatcagaggaaaaggtaatttcattagagaaaattctagcaacttgtctgaaaacggttacgaaaatagacaacaccctattaaaacttgtctaacttccaaaattacagaagtagaattagaatttcgtgtagaggttcctgcagaagctatcacagcttcacttaaacaagaaacccctgtagttgttattgctgatcgttggtaccacaccgatgatggaccattagcttacacactttcttttatccctatcgaacttatttcagatgctgagatttctttacatgatactaaacagttgttaaacttcattgaagaaggtatctatcaagaaggcatatcaagccactcacaaagccatttgggatatgcgacatctggcaatttttcagcaactaaatataccctatccgatcatggacaattcatattaatacaagaaacaatttttaagcaagagaaaatactaatgtgtaataagcattacgttcccattgagcactttgaattgtccattacctctcat

SEQ ID NO: 10248 - protein, 245 aa, Streptococcus agalactiae
MPKNELNNKLNKLKHVQVYNKIFNMIQDGTYSPGMQLPSEPELAGQLNVSRATLRKSLALLQEDHLVKNIRGKGNFIRENSSNLSENGYENRQHPIKTCLTSKITEVELEFRVEVPAEAITASLKQETPVVVIADRWYHTDDGPLAYTLSFIPIELISDAEISLHDTKQLLNFIEEGIYQEGISSHSQSHLGYATSGNFSATKYTLSDHGQFILIQETIFKQEKILMCNKHYVPIEHFELSITSH

SEQ ID NO: 10249 - DNA, 795 bp, Streptococcus agalactiae
atggtaaggctaatatttagtgatattgatggtactttaattaacagtaattttaaagtaacacctaagacacggcagggaattaaacaaatagtagctcaaggggctactttcgttcccatatcagctaggatgcctgaggcaattactccgattatggaacaaattggaatagattcttatattatttcctataatggggctttaatacaagatatgcaacaaaaaacaattgcttcccacacaatggatggtcaagttgccttacaagtttgttcttatgtaagcaagcattattcgaaaattgcatggaatgtctatcgttatcatgaatggtattcctgtgataaagaaaatgagtgggtccaaaaagaggaggagattgttggtttacaatctaaagagatgagtttgatggagttagagaagcaagataggattcataaacttctcttgatgggagaaccatctctgatgggagaattggagaacactttgaaagctcaatatccacatttatcaatcgcacaatctgctccttactttattgaaataatggctccaggtattgaaaaaggaaaatctgctaaaactttagcagactatttagatatttctcttgcagactctattgcgtttggtgataactataatgatttaaatctgcttgaaattgtgggtaaaggttttgtcatggggaatgctcctaaagatttacaagagagaattggaaatgtaactcaggataatgataacgatggtatttattatgctttagtagagtatatggaaaat

SEQ ID NO: 10250 - protein, 265 aa, Streptococcus agalactiae
MVRLIFSDIDGTLINSNFKVTPKTRQGIKQIVAQGATFVPISARMPEAITPIMEQIGIDSYIISYNGALIQDMQQKTIASHTMDGQVALQVCSYVSKHYSKIAWNVYRYHEWYSCDKENEWVQKEEEIVGLQSKEMSLMELEKQDRIHKLLLMGEPSLMGELENTLKAQYPHLSIAQSAPYFIEIMAPGIEKGKSAKTLADYLDISLADSIAFGDNYNDLNLLEIVGKGFVMGNAPKDLQERIGNVTQDNDNDGIYYALVEYMEN

SEQ ID NO: 10251 - DNA, 858 bp, Streptococcus agalactiae
atgtcgtatccatacaaagccaatcattccattgaatcaatcaccttaaaagtaaatgacctcgaaaacctcgtaaacttctatagcgatatcattgggttaactgttattgacaaatcaagcactagagccttactaggggtaaatcaaaaaatccctcttattatccttgaaaaaactgaacttgaaaagcatagtacctatggcctttatcacactgctattttagtaccagatgaataccatctcagtctagctctaaatcatttattatctcagcatatccctctagagggtggagctgaccatggctatagcaatgctatctatctaagtgatcctgaaggtaatggaattgaaatttataatgataaggatatctctatgtgggatatcagagagagtggacaaattattggtattactgaaagactagatattgacaatttacttgacagccttgtcaacgttcctaataattataagctttctgaaaaaactagtattggtcatattcatttgagtgttaaagatgctaagattagctcaaaactctatcaaaatgtttttggccttgatgagaaatttgcaatcccgacagctagttggattgcatccggcaactaccatcatcatctagcctttaataattgggctggtccaaatctttctaaaaaccaagaagatagacccggaatttccttattgacaattgcttacaatgatgacaacctttttagagatagcttaaaaaaagcgcaactttaccaactgactttccttgaaaaacaagatcattattatattattgaagattttgatggcatccgaattaaagttgttctaaaaccagagaat

SEQ ID NO: 10252 - protein, 286 aa, Streptococcus agalactiae
MSYPYKANHSIESITLKVNDLENLVNFYSDIIGLTVIDKSSTRALLGVNQKIPLIILEKTELEKHSTYGLYHTAILVPDEYHLSLALNHLLSQHIPLEGGADHGYSNAIYLSDPEGNGIEIYNDKDISMWDIRESGQIIGITERLDIDNLLDSLVNVPNNYKLSEKTSIGHIHLSVKDAKISSKLYQNVFGLDEKFAIPTASWIASGNYHHHLAFNNWAGPNLSKNQEDRPGISLLTIAYNDDNLFRDSLKKAQLYQLTFLEKQDHYYIIEDFDGIRIKVVLKPEN

SEQ ID NO: 10253 - DNA, 2169 bp, Streptococcus agalactiae
atgacagaatctgatatcaaagtgattaaacgtgacgggcgtttggtcagctttgataagtataaaatctacacggctctattaaaagctagtaataaagttatcaaaatgtctcctttagttgaggctaaacttgagatgattgcagatcatgtcatcgctgagatctacaatcgttttaaagataacatcaagatatatgaaatacaaaatatcgttgaacataaattattggaagctaatgagtacgctattgcacaagaatatatcaattatcgtacccaacgcgattttgagcgttcacaggctacagatatcaatttttctattggaaaattaattaataaggatcaaactgttgttaatgagaatgctaataaagactctgatgtgtttaatacccaacgtgatttaacagcaggtattgtagggaaatcaattggtctgaaaatgttaccttctcatgtagcaaatgcacatcaaaagggtgatatccattatcatgatttagattacagcccatacactcccatgacaaattgctgtttaatcgattttaagggaatgcttgcaaatggttttaagattggtaatgcagaagttgagagtccaaaatctattcagacagcgactgctcagatttcacagattattgcgaacgttgcttcaagtcaatatggtggctgtacagcagatcgcattgatgagtttttagctccttatgcacagttaaattatcaaaaacatttaaaagatgcaaaagaatgggttattgaagataaacaagaagactatgcgcgcgctaaaacacaaaaagatatatatgatgccatgcaatctttggagtatgaaattaatactttatttacttcaaatgggcaaacgccatttacttcgcttggttttggattaggaactaattggtttgaacgagaaattcaaaaagcgattttgaaaattcggattcaaggtttaggaagcgagcatcgtactgctatttttccaaaattaatttttacgcttaaaaaaggtcttaatttagaagaagatagccccaattatgatattaaacaattagcattagagtgtgcgacaaaacggatgtatccagatgtcctttcttatgataaaattattgacttaacgggctcttttaaagcccctatgggctgtcgttctttcctacaagggtggcgagatgcaaatggtcaggatgtaacatctggtcgtatgaatcttggagttgtaacagttaatctaccgcgtgttgccatggagtctaacggtgatatggataaattctgggagatatttaatgaacgtatgagtattgctagagatgccttggtttatcgtgtggaacgtgtcaaagaggctatcccagcaaatgcgcccattctttaccagtatggagcatttggagaacgtttaggaaaatatgacaatgttgatcgactctttaatcaccgccgtgcaacggtgtctcttggttatattggtttatatgaggtggcgagtgttttttatggtggtgactgggaagataaccatcaagctaaagcatttactgtagacatcgttcgtaagatgaagcagttatgtgcagattggtctgatgagtatgattatcatttttcagtttattcgacaccatcggagagcttgactgaccggttttgtcgtttagatactgaaaaatttggtatagtaactgatattactgataaggaatactacactaattcattccattatgatgtgcgtaagaatccaacaccttttgaaaaactagattttgagaaaatctatcctgaaacgggtgcatcaggaggatttattcactactgtgaataccctgttttgcaacagaatccaaaagctttagaagcagtttgggactatgcttatgatcgggtaggttatctaggtactaatacaccgattgataagtgttaccaatgtcaatttgaaggggattttacaccgacagatcgaggttttacttgtccaaattgtggtaacagcgaccctaagacagtagatgttgtcaaacgtacatgtggttatttaggtaatccacaggctcgtccgatggttaatggtcgtcataaggaaatctctgctcgtgtaaaacatatgaacggatcaagtattaaaaatcaaggtaat

SEQ ID NO: 10254 - protein, 723 aa, Streptococcus agalactiae
MTESDIKVIKRDGRLVSFDKYKIYTALLKASNKVIKMSPLVEAKLEMIADHVIAEIYNRFKDNIKIYEIQNIVEHKLLEANEYAIAQEYINYRTQRDFERSQATDINFSIGKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAQLNYQKHLKDAKEWVIEDKQEDYARAKTQKDIYDAMQSLEYEINTLFTSNGQTPFTSLGFGLGTNWFEREIQKAILKIRIQGLGSEHRTAIFPKLIFTLKKGLNLEEDSPNYDIKQLALECATKRMYPDVLSYDKIIDLTGSFKAPMGCRSFLQGWRDANGQDVTSGRMNLGVVTVNLPRVAMESNGDMDKFWEIFNERMSIARDALVYRVERVKEAIPANAPILYQYGAFGERLGKYDNVDRLFNHRRATVSLGYIGLYEVASVFYGGDWEDNHQAKAFTVDIVRKMKQLCADWSDEYDYHFSVYSTPSESLTDRFCRLDTEKFGIVTDITDKEYYTNSFHYDVRKNPTPFEKLDFEKIYPETGASGGFIHYCEYPVLQQNPKALEAVWDYAYDRVGYLGTNTPIDKCYQCQFEGDFTPTDRGFTCPNCGNSDPKTVDVVKRTCGYLGNPQARPMVNGRHKEISARVKHMNGSSIKNQGN

SEQ ID NO: 10255 - DNA, 1485 bp, Streptococcus agalactiae
atgagtaaacgaacggctatcagaatgaagaaatctagtcgattttcaattttactatatagtgttttgtcaactctcttagcaattgcaaatcctttattgacttattttgcaaatggtttgcagactcagaatctctatacaggtttgatgatgaccaaaggacagatcccttatagtgatgtttttgctacaggaggatttttatactatgtaacgattgctctaagttaccttttagggtctagtatctggttacttattgtacagtttattgcttactatgtatctggaatttatttttataaattagtttattatgtggcacaaagtgaaattgtctcgataggcatgacgttgattttctatataatgaatattgtcttaggattcggtggtatgtacccaatacagtgggcattaccttttatgctcatttcgctatggtttttaattaaattttgtgtcgataatatcgttgatgaagcatttatattttatggcattttagcagcattctcactatttatagatccccaaacactgattttttggctttgctcttttgttctcttaacagcaaccaatattaagcaaaagcagtcactacgaggattttatcagtttttatgcgttgtttttggtatgattttaattgcttatactgttggttactttatgtttaatctacagattatctcttcttatattgacaaagctattttttacccctttacgtatttcgctaggacaaaccactcattccttcttagtttagcaattcaaattgttgtccttctagggtcaggttgtctctttggactatgggattttattcaaaatcgtaaaaaagcatcttatcaaatcggcttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaa

SEQ ID NO: 10256 - protein, 495 aa, Streptococcus agalactiae
MSKRTAIRMKKSSRFSILLYSVLSTLLAIANPLLTYFANGLQTQNLYTGLMMTKGQIPYSDVFATGGFLYYVTIALSYLLGSSIWLLIVQFIAYYVSGIYFYKLVYYVAQSEIVSIGMTLIFYIMNIVLGFGGMYPIQWALPFMLISLWFLIKFCVDNIVDEAFIFYGILAAFSLFIDPQTLIFWLCSFVLLTATNIKQKQSLRGFYQFLCVVFGMILIAYTVGYFMFNLQIISSYIDKAIFYPFTYFARTNHSFLLSLAIQIVVLLGSGCLFGLWDFIQNRKKASYQIGLNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 10257 - DNA, 408 bp, Streptococcus agalactiae
atgggacttgacgtcggctcgaaaactgtcggcgttgcaattagtgatccactcggtttcactgcacaaggtcttgaaatcattaagatcgatgaagaatctggaaattttggttttgaccgcttagcagagttagtaaaagagtacaaagttgataaatttgtagttggtctacctaaaaatatgaataatacaagtggtcctcgtgtagaggctagtcaggcatatggcgataaaatcactgaattattcaatcttccagttgaatatcaagatgaacgtttaacgactgttcaagcagagcgtatgctagttgagcaagctgatattagtcgtggtaagcgtaagaaagttatcgataaattagcagctcaactaatcttacaaaattatttagaccgcatgttt

SEQ ID NO: 10258 - protein, 136 aa, Streptococcus agalactiae
MGLDVGSKTVGVAISDPLGFTAQGLEIIKIDEESGNFGFDRLAELVKEYKVDKFVVGLPKNMNNTSGPRVEASQAYGDKITELFNLPVEYQDERLTTVQAERMLVEQADISRGKRKKVIDKLAAQLILQNYLDRMF

SEQ ID NO: 10259 - DNA, 396 bp, Streptococcus agalactiae
atgattaagatttatactatttcaagttgcacaagttgtaaaaaagcaaaaacttggctaaatgctcatcaacttccatataaagaacaaaacctaggtaaagaatcactaacacgtgatgaaattttagaaatattaacaaaaactgaaagtggtattgaaagtatcgtttcttctaaaaatcgttatgctaaggcgctcaattgtaatattgaggagttgagtgtaaatgaagttattgatcttattcaagaaaatccacgtattttaaagagtccaattctaattgatgacaaacgtcttcaagtaggttataaggaagatgatattcgtgcttttctacctcgctctattcgtaacgttgaaaatgcagaagctcgtcttcgtgcagcactt

SEQ ID NO: 10260 - protein, 132 aa, Streptococcus agalactiae
MIKIYTISSCTSCKKAKTWLNAHQLPYKEQNLGKESLTRDEILEILTKTESGIESIVSSKNRYAKALNCNIEELSVNEVIDLIQENPRILKSPILIDDKRLQVGYKEDDIRAFLPRSIRNVENAEARLRAAL

SEQ ID NO: 10261 - DNA, 816 bp, Streptococcus agalactiae
atggttttaccaggtccgcctagtgaattaaagccaatggttatggagcaggtagtacctattttgtcaaataatggcacaaaattatattcacgtgtattgagattctttggtatcggtgagagtcagttagtcacaatcttagaagacataattaagaatcagacagacccaactatagcaccatatgcaaaggttggtgaggtaactttaaggttatcaacgaaagctgaaaatcaggatgaggccgactttaaattagatagcttagaaaaagaaatacttgctcttaagacattagataaccgtaaattaaaagatttattatatggttatggtgataataatagtatggcacgtactgttttagaattattgaaagtacaaaataaaacgattactgccgcagagagcttaacagcagggttatttcaatctcagttagcagaattttctggtgcttcgcaagtttttaatggtggttttacgacctatagtatggaagcaaaatcacaacttctcggcatccctaagaaaaaattgcaagaatatggagttgtcagtcattttacagctgaggcaatggctcagcaagctcgccaacttttaaaagcagattttggtatcggtttaacgggagttgctggtcctgatgagttggaaggataccctgcaggtacagtttttattgggattgcaacccctgaaggcgtttcttctattaaagtatcgattggagggaagagtcgctcagatgtccgtcatatcagtactttacatgcttttgacttggtgcgtagggctttattaaagata

SEQ ID NO: 10262 - protein, 272 aa, Streptococcus agalactiae
MVLPGPPSELKPMVMEQVVPILSNNGTKLYSRVLRFFGIGESQLVTILEDIIKNQTDPTIAPYAKVGEVTLRLSTKAENQDEADFKLDSLEKEILALKTLDNRKLKDLLYGYGDNNSMARTVLELLKVQNKTITAAESLTAGLFQSQLAEFSGASQVFNGGFTTYSMEAKSQLLGIPKKKLQEYGVVSHFTAEAMAQQARQLLKADFGIGLTGVAGPDELEGYPAGTVFIGIATPEGVSSIKVSIGGKSRSDVRHISTLHAFDLVRRALLKI

SEQ ID NO: 10263 - DNA, 549 bp, Streptococcus agalactiae
atgaaacgatgttcttgggtgaatttagataatccattatatgtagcttaccatgataaagagtgggggagagctgttcatgacgatcatgtactctttgagttactatgtttagaaacttatcaatcgggtttatcttgggaaacagtattaaataaacgtcaggagttcagacaagtttttcatcactataatattgaaaaggtagctgcaatgtcagatgcggatttagagataatcttacaaaatcctagggttattcgtcatcgtctaaaacttttctcaacacgacaaaatgctaggtcaattatattaattcagaaagaattcggaagttttgatcgctacatttggtcttttgtagataataaagtacaggttaactcagttaacaactacaacgatgtgcctgcaagtactaccttatccgaacgcttatctaaggatttaaaaaaacgcggttttaaatttgttggtccaacttgcctctattcttttattcaggccgcgggtatggttaatgaccatgaaaatatatgtgatttcaag

SEQ ID NO: 10264 - protein, 183 aa, Streptococcus agalactiae
MKRCSWVNLDNPLYVAYHDKEWGRAVHDDHVLFELLCLETYQSGLSWETVLNKRQEFRQVFHHYNIEKVAAMSDADLEIILQNPRVIRHRLKLFSTRQNARSIILIQKEFGSFDRYIWSFVDNKVQVNSVNNYNDVPASTTLSERLSKDLKKRGFKFVGPTCLYSFIQAAGMVNDHENICDFK

SEQ ID NO: 10265 - DNA, 1230 bp, Streptococcus agalactiae; identical to SEQ ID NO: 8725

SEQ ID NO: 10266 - protein, 410 aa, Streptococcus agalactiae
MKEFFALPKQLQLRELLRFISITVGSAIFPFMAMYYVQYFGNLVTGILIIITQLSGFVATLYGGHLSDAMGRKKVVIIGSLLATIGWAITIAANVPNHITPHLTFVGILIIEIAHQFYFPAYEAMTIDLTNEQNRRFVYTIGYWLVNIAVMLGSGIAGIFYDHHFFELLIVLLIISAICCFVVYFKFDETKPQEGTFKHDKGVLGTFKNYSQVLVDKAFVVYTLGAIGSSVVWLQVDNYFSVNLKQNFEVVSILGHTITGAKMLSLAVFTNTLLIVLLMTTINKFIENWPLKRQLILGSLICGFGMLFNISLNTFGAILIAMTFFTFGEMIYVPASQVLRAEMMVEGKIGSYSGFLAIAQPVASVLAGAMVSLSYFTGKIGVQITLTIFMLAGLVLILYATKMKNIEIGK

SEQ ID NO: 10267 - DNA, 1977 bp, Streptococcus agalactiae
atgaacttgtctaaaattattgaattaccggatatattagctaaccagattgctgctggtgaggttgttgaaaggcctagtagcgtcgttaaagaattagttgaaaatgccatagatgcaggaagtagccaaattaccatagaggttgaagaatctggtcttaaaaagattcaaataacggataacggtgaagggatgactagtgaggatgccgttctcagtttacgacgtcacgctacatccaaaatcaaaagccagagtgacctttttcgtattcggaccttaggttttcgtggtgaagctctaccatcaatcgcttcgattagtttaatgacgataaaaacagctacagagcaagggaaacaagggacgttacttgttgctaaagggggaaacattgaaaaacaggaagttgtttcaagtcctcgtggaacaaaaattttagttgaaaatttattctttaacacgcctgccagattgaaatacatgaagagtttacagtctgaactagctcatattattgatattgttaatagactcagtctagcgcatccggaagttgcttttacactgataaatgatggtaaagaaatgactaaaactagtgggactggcgatttgagacaggcgattgcaggtatttatggtttaaatactgcaaaaaaaatgattgagatttcaaatgcagatttagattttgaaatttcgggttatgtaagtttgcctgaattgacacgagctaaccgaaactatattaccctattaattaacggtcgttacattaaaaattttcttttgaaccgctcaattctagatggttatggttcaaagttgatggttggaagatttccaattgctgtcattgatattcagatagatccttatctagcagatgtcaacgttcatccgactaagcaagaggtgagaatttctaaggaacgagaattaatgagtttaataagcacagcaatttctgagagtcttaaacaatatgacttgattccggatgctttagagaatttagctaaaactagtacccgaagtgtagataagcctatacaaacaagcttctcactaaaacagcctggtttgtattacgatagggctaaaaatgacttttttataggtgcagatactgtatctgaacctattgctaactttacaaaccttgacaaaagtgacggttcagttgacaatgatgtaaaaaactctgttaatcaaggagcaacgcagtctcctaatataaagtatgctagtagagatcaagctgatagtgagaacttcattcattctcaggattaccttagtagtaaacagtcacttaacaaacttgttgaaaaattagattcggaagaaagttcgacttttccagagctcgaattttttggtcaaatgcatgggacctacttatttgctcaagggaatggtgggttgtatattattgatcaacatgcagctcaagagcgtgtaaaatacgagtattaccgtgaaaagataggtgaggttgataatagtcttcaacaattgttagtaccatttctatttgaattttcaagttcagattttcttcaattacaagaaaaaatgtcattattacaagatgttggtattttcttggaaccgtatggtaataatactttcattttaagggaacatccaatttggatgaaagaagaagaggtagagtctggcatttatgaaatgtgtgatatgttgttgctcactaatgaagtatcagtgaaaaaatatcgcgcagagttggctattatgatgtcttgcaagcgatctattaaagcaaaccatacgctagacgattactcagcacgtcatttattagatcagttagcgcaatgtaaaaatccttataattgccctcatggaagacctgttttagttaattttacaaaagctgatatggagaaaatgtttaaacgaatccaagaaaatcatacaagcctcagggatttaggaaaatat

SEQ ID NO: 10268 - protein, 659 aa, Streptococcus agalactiae
MNLSKIIELPDILANQIAAGEVVERPSSVVKELVENAIDAGSSQITIEVEESGLKKIQITDNGEGMTSEDAVLSLRRHATSKIKSQSDLFRIRTLGFRGEALPSIASISLMTIKTATEQGKQGTLLVAKGGNIEKQEVVSSPRGTKILVENLFFNTPARLKYMKSLQSELAHIIDIVNRLSLAHPEVAFTLINDGKEMTKTSGTGDLRQAIAGIYGLNTAKKMIEISNADLDFEISGYVSLPELTRANRNYITLLINGRYIKNFLLNRSILDGYGSKLMVGRFPIAVIDIQIDPYLADVNVHPTKQEVRISKERELMSLISTAISESLKQYDLIPDALENLAKTSTRSVDKPIQTSFSLKQPGLYYDRAKNDFFIGADTVSEPIANFTNLDKSDGSVDNDVKNSVNQGATQSPNIKYASRDQADSENFIHSQDYLSSKQSLNKLVEKLDSEESSTFPELEFFGQMHGTYLFAQGNGGLYIIDQHAAQERVKYEYYREKIGEVDNSLQQLLVPFLFEFSSSDFLQLQEKMSLLQDVGIFLEPYGNNTFILREHPIWMKEEEVESGIYEMCDMLLLTNEVSVKKYRAELAIMMSCKRSIKANHTLDDYSARHLLDQLAQCKNPYNCPHGRPVLVNFTKADMEKMFKRIQENHTSLRDLGKY

SEQ ID NO: 10269 - DNA, 435 bp, Streptococcus agalactiae
atgaataaaatagaacgccaaaaacgtattaaacgtttgatccaatcagggcagattggcacacaagaagaaattaaattacatttaaaaaatgaaggaatcgatgtcacgcaagcgactctatcaagagacttgcgtgagattggtcttttaaaattacgtagcccagaaggtaagctatattatagtttatcaacagctacttcaaatcgatttagcccagccttacgctcatatattttgaaagtatcgcgagcaagttttatgttagttttaaatactaatttaggggaggctagcgttttagcaaactttattgatgagaaagggctgccagagattttaggaacaatggcaggagcagacaccttgttggtgatttgtcaaaatgaagatattgccaaagtttttgaaaaagaactatcagtaggttta

SEQ ID NO: 10270 - protein, 145 aa, Streptococcus agalactiae
MNKIERQKRIKRLIQSGQIGTQEEIKLHLKNEGIDVTQATLSRDLREIGLLKLRSPEGKLYYSLSTATSNRFSPALRSYILKVSRASFMLVLNTNLGEASVLANFIDEKGLPEILGTMAGADTLLVICQNEDIAKVFEKELSVGL

SEQ ID NO: 10271 - DNA, 1689 bp, Streptococcus agalactiae
atggatacaaaacatctaattgcgagtgaaattcaaaaagttgttccagatatggaacaatcgaccattctttctttattagaaaccccaaaaaattcgagcatgggagatttagctttcccagcattctctttggctaaaactctacgcaaagcacctcaaataattgctagtgacattgctgaacaaattaaaagcgaccaatttgaaaaggtggaagctgttggaccttacgttaactttttccttgataaagccgcaatctcaagtcaagttttaaaacaagtcttatctgatggttctgcctatgctactcaaaatattggtgaaggacgaaatgttgccattgacatgtctagtccaaatattgctaagccattctcaattggacaccttcgttcaacagttattggtgatagtttagctaatatttttgataaaattggctatcatcctgttaaaattaatcaccttggcgactggggtaaacaatttggaatgttaatcgttgcctataaaaaatggggcaatgaagaggctgtccgtgctcatcccatcgatgaacttttaaaactttatgtccgtattaatgctgaagccgagacagaccctagcgttgatgaagaggcacgtgagtggtttcgtaaacttgaagctaacgatcctgaagcaactgaattatggcaatggttccgtgacgagtcattattagaattcaaccgtctttacgatcaaatgaatgttacatttgatagctataacggcgaggcattctacaacgacaaaatggatgaagtgcttgaactgctagaatctaaaaacctcctagtcgaatctaaaggtgcacaagttgttaacctagaaaaatacggtattgaacatcctgccctcattaaaaaatccgatggagcaactctctacattacacgtgacttagctgctgcactttaccgtaaacgtacctacgattttgcaaaatcaatctacgttgtaggaaacgaacagtctgcacactttaagcaactaaaagctgtgcttaaagaaatggactacgattggtccgatgatatgactcatgttccttttggccttgtaacaaaaggaggagcaaaattatcaactcgtaaaggaaatgtaattctacttgaacctactgttgcagaagctattaatcgtgcggcatctcagattgaagctaaaaaccctaacctagcagataaagataaagttgctcaagcagttggtgtaggtgctattaaattttacgatttgaaaactgatcgtacaaatggttatgactttgacttagaagcaatggtatcatttgaaggtgaaactgggccatatgtacaatatgcacatgctcgtattcaatcaatcttacgtaaagctaactttagcccatctaatagcgataattacagtctcaacgatgttgaaagctgggaaatcatcaaactcatccaagattttcctcgtattattgtacgtgcggcagataattttgagccctctattattgcaaaattcgctattaatttagctcagtgcttcaataaatattacgcccacacacgtattttagatgaagacgctgaaatcagtagtcgtctagcactttgctatgcaactgctacagtattaaaagaatctcttcgcctcctaggagttgatgctccgaatgaaatg

SEQ ID NO: 10272 - protein, 563 aa, Streptococcus agalactiae
MDTKHLIASEIQKVVPDMEQSTILSLLETPKNSSMGDLAFPAFSLAKTLRKAPQIIASDIAEQIKSDQFEKVEAVGPYVNFFLDKAAISSQVLKQVLSDGSAYATQNIGEGRNVAIDMSSPNIAKPFSIGHLRSTVIGDSLANIFDKIGYHPVKINHLGDWGKQFGMLIVAYKKWGNEEAVRAHPIDELLKLYVRINAEAETDPSVDEEAREWFRKLEANDPEATELWQWFRDESLLEFNRLYDQMNVTFDSYNGEAFYNDKMDEVLELLESKNLLVESKGAQVVNLEKYGIEHPALIKKSDGATLYITRDLAAALYRKRTYDFAKSIYVVGNEQSAHFKQLKAVLKEMDYDWSDDMTHVPFGLVTKGGAKLSTRKGNVILLEPTVAEAINRAASQIEAKNPNLADKDKVAQAVGVGAIKFYDLKTDRTNGYDFDLEAMVSFEGETGPYVQYAHARIQSILRKANFSPSNSDNYSLNDVESWEIIKLIQDFPRIIVRAADNFEPSIIAKFAINLAQCFNKYYAHTRILDEDAEISSRLALCYATATVLKESLRLLGVDAPNEM

SEQ ID NO: 10273 - DNA, 1749 bp, Streptococcus agalactiae
atgaaacgtagtatgtatgctgggcgtgttcgtagtgagcacataggaacatcgattactttaaaaggatgggttggtcgtcgtcgtgaccttggaggccttatttttattgatcttcgcgatcgcgagggaatcatgcaattagttattaatcctgaagaagtatcagcctcagttatggcaaccgcagaaagtctccgtagtgaatttgttatagaggttagcggtgtagtgacagcacgagaacaagctaatgataatttaccaacaggagaagttgaattaaaagtgcaagaattatcgattcttaatacctcgaaaacaacaccatttgaaattaaagatggtattgaggcaaatgatgatacacgcatgcgttaccgttacttggatcttcgtcgtccggaaatgcttgaaaatttcaaattacgtgcgaaagtaacacactcaatccgtaattaccttgacaacttagagtttattgatgtcgaaactccgatgctaacaaaatcaactccagagggggcacgagactatttggttccatcacgtgtcaaccaaggacatttttatgcccttccacaaagccctcaaattacaaaacagctattgatgaatgcgggatttgatcgttattatcaaattgtcaaatgtttccgtgatgaggatttacgtggagaccgtcaacctgagtttacacaagttgacttagagacatcattccttagtgatcaagaaattcaagacattgttgagggtatgattgctaaagtaatgaaagacactaaaggtttagaggtttctttaccattcccaaggatggcatatgatgatgcaatgaataactacgggtctgataagcctgatacaaggtttgatatgcttttacaagacttgacagaaattgtcaaagaagttgacttcaaggtgttctcagaagcttcagtagttaaagcgattgttgtcaaagataaggcggacaagtactctcgaaaaaatattgataaattaacagaaattgcaaaacaatacggtgccaaaggtttagcatggctaaaatatgcagataatactatttcaggtccggttgctaagttcttgacagctattgaaggtaggttgacagaagctttacagctagagaataatgacttaattctatttgtagcagatagtcttgaagtagctaacgagactttaggagcgcttcgtacacgcattgcaaaagaacttgaactcattgattattctaaatttaatttcctatgggttgttgattggccaatgtttgagtggtcagaagaagagggacgatatatgtcggctcatcatccattcaccttgccaacagcggagacagcgcatgagttggaaggggatttggctaaagtacgtgcagttgcctatgatattgttttgaatggatatgagttaggcggtggtagcctacgtattaaccaaaaagatacacaagagcgtatgttcaaggctttaggatttagcgctgaatcagctcaggaacagtttggtttcttacttgaagctatggattacggcttcccaccacatggtggattggcaataggccttgaccgctttgttatgttgttagcaggcaaggacaatattcgagaagttattgcattccctaaaaacaataaggctagtgatccaatgactcaagctcctagtctcgtttcagaacaacaattagaagaattatcacttactgtagaaagttatgaaaac

SEQ ID NO: 10274 - protein, 583 aa, Streptococcus agalactiae
MKRSMYAGRVRSEHIGTSITLKGWVGRRRDLGGLIFIDLRDREGIMQLVINPEEVSASVMATAESLRSEFVIEVSGVVTAREQANDNLPTGEVELKVQELSILNTSKTTPFEIKDGIEANDDTRMRYRYLDLRRPEMLENFKLRAKVTHSIRNYLDNLEFIDVETPMLTKSTPEGARDYLVPSRVNQGHFYALPQSPQITKQLLMNAGFDRYYQIVKCFRDEDLRGDRQPEFTQVDLETSFLSDQEIQDIVEGMIAKVMKDTKGLEVSLPFPRMAYDDAMNNYGSDKPDTRFDMLLQDLTEIVKEVDFKVFSEASVVKAIVVKDKADKYSRKNIDKLTEIAKQYGAKGLAWLKYADNTISGPVAKFLTAIEGRLTEALQLENNDLILFVADSLEVANETLGALRTRIAKELELIDYSKFNFLWVVDWPMFEWSEEEGRYMSAHHPFTLPTAETAHELEGDLAKVRAVAYDIVLNGYELGGGSLRINQKDTQERMFKALGFSAESAQEQFGFLLEAMDYGFPPHGGLAIGLDRFVMLLAGKDNIREVIAFPKNNKASDPMTQAPSLVSEQQLEELSLTVESYEN

SEQ ID NO: 10275 - DNA, 1278 bp, Streptococcus agalactiae
atgaaacttcaaaaaccaaaagggactcaggatatcttacctggagaatcagcaaagtggcaatacgttgaaaatgttatacgcaatctctttaaacaatatcattatgatgaaattcgtacaccaatgtttgaacattacgaggttattagtcgctcagttggggatacaacggatatcgttacaaaagagatgtatgattttcatgataaaggagatcgtcacattacgcttcgtccagaaggaacagcacctgttgtacgttcttatgttgaaaataaactatttgcaccagaagttcaaaaaccaaccaaaatgtattatattggatcaatgttccgatatgagcgcccacaggctggtcgtttacgagaatttcatcaagtaggcgttgagtgctttggatcaaataatccagcaactgatgttgaaacaatcgcaatgggacatcatctatttgaagatttaggtatcaaaaacgttaaacttcatcttaatagtttagggaatccagaaagtcgtcaggcctatcgccaagctcttattgattacttaacacccatacgtgaacaattgtctaaggatagtcaacgtcgtttgaatgaaaatccattgcgcgtactagactctaaggagccagaagacaaactagcagttgaaaatgctccttctattttagattatttagatgagtcaagccaagcccactttgatgctgtgtgtcatatgcttgatgctctaaatattccatacatcattgatactaatatggttcgtggtcttgattattataatcatactatttttgagtttatcactgagattgaagataatgaattaacgatctgtgctggaggccgttatgacggcttagtatcctattttggtggaccagaaacaccagcatttggttttggattaggattagaacgcttgctcttaatattagataagcaagggatttctttaccaatagaaaatactatagatctgtatatagctgtattaggatcagaggctaatctagctgccttagatttggcacaatcaatacgtcatcagggttttaaagtagagcgtgattatttgggtcgtaaaatcaaagcacaatttaagtctgcagatacttttaatgctaaagtgattatgacattaggtagcagtgaagtagattcgaaagaggtcggtttaaaaaataatcaaacacgtcaagaagttaaagttagttttgaaaacattaaaacagatttttcatctgtgcttaaacaattaggattg

SEQ ID NO: 10276 - protein, 426 aa, Streptococcus agalactiae
MKLQKPKGTQDILPGESAKWQYVENVIRNLFKQYHYDEIRTPMFEHYEVISRSVGDTTDIVTKEMYDFHDKGDRHITLRPEGTAPVVRSYVENKLFAPEVQKPTKMYYIGSMFRYERPQAGRLREFHQVGVECFGSNNPATDVETIAMGHHLFEDLGIKNVKLHLNSLGNPESRQAYRQALIDYLTPIREQLSKDSQRRLNENPLRVLDSKEPEDKLAVENAPSILDYLDESSQAHFDAVCHMLDALNIPYIIDTNMVRGLDYYNHTIFEFITEIEDNELTICAGGRYDGLVSYFGGPETPAFGFGLGLERLLLILDKQGISLPIENTIDLYIAVLGSEANLAALDLAQSIRHQGFKVERDYLGRKIKAQFKSADTFNAKVIMTLGSSEVDSKEVGLKNNQTRQEVKVSFENIKTDFSSVLKQLGL

SEQ ID NO: 10277 - DNA, 519 bp, Streptococcus agalactiae
atgagaacatattcagataaaaacgaacttaaggaagaagtactaaaatcatataaaaaatatattgctgaattcaatgacattcctgagaagttgaaagatttaagaattgatgaggttgataggacaccagcggagaatctagcctatcaggttggctggactaccctgatactaaaatgggagtcagatgaacagagtggcttagaagttaaaacaccaactgagacgtttaaatggaatcaacttggagagctatatcagcattttactgagacctacgctagtctaaccatcaaagaacttacggctcaactcaatgataatgtagatgctataggtaacatgattgattcaatgagcgacgaagtcctatttaaacctcatatgagaaattgggctgatagtgcgactaagaatgcagtctgggaagtttataagtttattcatattaatacggtagctcctttcggaacatttagaactaagattcgcaagtggaaaaaagttgctttaaag

SEQ ID NO: 10278 - protein, 173 aa, Streptococcus agalactiae
MRTYSDKNELKEEVLKSYKKYIAEFNDIPEKLKDLRIDEVDRTPAENLAYQVGWTTLILKWESDEQSGLEVKTPTETFKWNQLGELYQHFTETYASLTIKELTAQLNDNVDAIGNMIDSMSDEVLFKPHMRNWADSATKNAVWEVYKFIHINTVAPFGTFRTKIRKWKKVALK

SEQ ID NO: 10279 - DNA, 1119 bp, Streptococcus agalactiae
atggataacaaattcaaaaatatcccaaaacggcatttaccacaaaaactcccatttgactacacgtcaatatatactgacccacaaatcattaaattaactactagggcaaatattgcaatcggtacttacgaaggatttctagagtctatcattaaccctatgctactaatctcccctttgcttagccaagaagccgttctctcttcaaaacttgaagggacccatgccaccttgaaagacttacttaattatgaagctggtaataaagtagatattgagcgtgatgaattgcatgaaatcattaactaccgaaaggctctcttttatgctctagaaaacatttccaccatcaacaacatcgattctaaaggattaccgttatccaatagaattattaaagaaatgcacaaaattcttctagataatgttagaggtagtagtaaaaatcctggtaattttaagagaagtcaaaactatatcggtagtgtatcctcgatttcatacactcctgtccccgcggaaaaaacaccagaatacatgtctaatttggagcaatatatccattatgatgacttagacttattggttcagtcagcaattatccatgctcaatttgaaatgattcacccttttgaagacggtaatggacgaattggacgattgcttataccactattcctgtactatcaggaactactttcttatccaacattttatatgagttcgtattttgaaagagataggtctctttacatatcacacctatcaaacatttcaaaagacaacaactggaaagactggtttgagtattacctagaaggagtgatattgtccgcagaagagagtacaaaaaaagctcaggacatactaagcctatataacattatgaaggaacaagtcatccctaaacttaattctgtttcaggtatccagcttcttgactttatattctcggctccaatctttaaggcagaacaagttagtgaacacctaaaaatttctaagagaactacctatactttactaaataagttaattgatgaaggttatctttcaacagataatgctcaaaggaatagaacctactattgtcctcaacttctttcaatcgttcaa

SEQ ID NO: 10280 - protein, 373 aa, Streptococcus agalactiae
MDNKFKNIPKRHLPQKLPFDYTSIYTDPQIIKLTTRANIAIGTYEGFLESIINPMLLISPLLSQEAVLSSKLEGTHATLKDLLNYEAGNKVDIERDELHEIINYRKALFYALENISTINNIDSKGLPLSNRIIKEMHKILLDNVRGSSKNPGNFKRSQNYIGSVSSISYTPVPAEKTPEYMSNLEQYIHYDDLDLLVQSAIIHAQFEMIHPFEDGNGRIGRLLIPLFLYYQELLSYPTFYMSSYFERDRSLYISHLSNISKDNNWKDWFEYYLEGVILSAEESTKKAQDILSLYNIMKEQVIPKLNSVSGIQLLDFIFSAPIFKAEQVSEHLKISKRTTYTLLNKLIDEGYLSTDNAQRNRTYYCPQLLSIVQ

SEQ ID NO: 10281 - DNA, 528 bp, Streptococcus agalactiae
atgtcttttgaacataagcatgaaggacacgataaacatcacgatcatagagaaaaatactcactaaaaacattaaagaatatctcgacaaaaatcgattataagactgccttagaaactgccaaaaaagaagctcgctcaggctttatttcacaaattgaattaaataccaaaggtgatacacctttttatgaaatcaaagttattgataataaaatagctaaaaaatataaaattgatgctaattctgggaagatcctttcaacaacatcagataatcaactcaattcaaaagatgcccaattaaaacaaccaagtaaagatattcagactgcattacaagctattcaagcaaaatataaaaatgcaaaaataaaagaaatttctcttgcgaataacaaatcaaataagctagtttataaagtaaaactacttgatggaaatactcctaagattgcccaatttgatagtgataaagcatcatttataaaggcaaataagcttaatacaactcataaaaatcacgac

SEQ ID NO: 10282 - protein, 176 aa, Streptococcus agalactiae
MSFEHKHEGHDKHHDHREKYSLKTLKNISTKIDYKTALETAKKEARSGFISQIELNTKGDTPFYEIKVIDNKIAKKYKIDANSGKILSTTSDNQLNSKDAQLKQPSKDIQTALQAIQAKYKNAKIKEISLANNKSNKLVYKVKLLDGNTPKIAQFDSDKASFIKANKLNTTHKNHD

SEQ ID NO: 10283 - DNA, 2538 bp, Streptococcus agalactiae
ttgaaaaagctaattgaaaaagtcaaatcactgacttctgtgattaaaattgtattttttatatctgttttagtgcttattattgttgaaatgattcatttgaaacgaactatttctgttgagcaactaaagagtgtttttgggcaattatctccaatgaatcttttcttaattatccttgtgggggttatcgctgtcttaccgacaaccggatatgactttgtactgaatggacttttacgtacagataaaagcaaaaggtatattttacagactagttggtgtatcaacacttttaataacttgtcaggattcggtggcttaatcgatattgggttgcgcatggctttttatggtaaaaaaggtcaagagaagagtgacctaagagaagtgactcgttttttaccctatcttatttctggtctgtcatttattagtgtgattgccttaatcatgagccatatttttcatgccaaagctagtgttgattactattatttggtattaattggtgctagtatgtattttcctgttatttattggatttctggtcataaaggaagccattatttcggagatatgccatctagtactcgtataaaattaggtgttgtttctttttttgaatggggatgtgcggccgcagcatttataattatcggttatttaatgggcattcatctaccagtttataaaattttaccactattttgtattggttgtgccgtcgggattgtatcccttattcccggtggattaggaagttttgaattagttctatttacagggtttgctgccgagggactacctaaagaaactgtggttgcatggttattactttatcgtttagcctactatattattccattctttgcaggtatctatttctttatccattatttaggtagtcaaataaatcaacgttatgaaaatgtcccgaaagagttagtatcaactgttctacaaaccatggtgagccatttgatgcgtattttaggtgcattcttaatattttcaacagcattttttgaaaatattacttatattatgtggttgcagaagctaggcttggacccattacaagaacaaatgttatggcagtttccaggtttattgctgggggtttgttttattctcttagctagaactattgatcaaaaagtgaaaaatgcttttccaattgctattatctggattactttgacattgttttatcttaatttaggtcatattagttggcgactatctttctggtttattttactattgttaggcttattagtcattaagccaactctctataaaaaacaatttatttatagctgggaagagcgtattaaggatggaatcattatcgttagtttaatgggagttctattttatattgcaggactactattccctatcagggctcatattacaggtggtagtattgaacgcctgcattatatcatagcatgggagccgatagcattggctacgttgattcttactctcgtttatttatgtttggttaagattttacaaggaaaatcttgtcagattggtgatgtgttcaatgtggatcgttataaaaaactacttcaagcttacggtggttcttcggatagcggtttagcctttttaaatgataaaaggctctactggtaccaaaaaaatggagaagattgcgttgcgttccaatttgtaattgtcaataataaatgtcttattatgggggaaccagccggtgatgacacttatattcgtgaagctattgaatcgtttattgatgatgctgataagctagactatgaccttgttttttacagtattggacagaagttgacactacttttacatgagtatggttttgactttatgaaagttggtgaggatgctttagttaatttagaaacgtttactcttaaagggaataagtacaaacctttcagaaatgccctaaatagagttgaaaaggatggtttctatttcgaagttgtacaatcgccacatagtcaagagctactaaatagtttggaagagatttctaatacttggttagaaggacgtcctgaaaaaggtttctcactaggatattttaataaagattatttccaacaagccccaatagctttggtaaaaaatgctgaacacgaagttgttgcttttgctaatattatgccaaactatgaaaagagtattatctctattgatttaatgcgtcacgataaacagaaaattccgaatggcgttatggatttcctctttttatcattattctcttattatcaagagaagggataccactattttgatttggggatggcacctttatcaggagttggtcgcgttgaaacaagttttgctaaagagagaatggcgtatcttgtctatcatttcggtagtcatttctactcatttaatggtttacacaagtataagaagaagtttacaccattgtggtcggaacgttatatttcttgttctcgttcgtcctggttaatttgtgctatttgtgccctattaatggaagatagtaaaattaagattgttaaa

SEQ ID NO: 10284 - protein, 846 aa, Streptococcus agalactiae
MKKLIEKVKSLTSVIKIVFFISVLVLIIVEMIHLKRTISVEQLKSVFGQLSPMNLFLIILVGVIAVLPTTGYDFVLNGLLRTDKSKRYILQTSWCINTFNNLSGFGGLIDIGLRMAFYGKKGQEKSDLREVTRFLPYLISGLSFISVIALIMSHIFHAKASVDYYYLVLIGASMYFPVIYWISGHKGSHYFGDMPSSTRIKLGVVSFFEWGCAAAAFIIIGYLMGIHLPVYKILPLFCIGCAVGIVSLIPGGLGSFELVLFTGFAAEGLPKETVVAWLLLYRLAYYIIPFFAGIYFFIHYLGSQINQRYENVPKELVSTVLQTMVSHLMRILGAFLIFSTAFFENITYIMWLQKLGLDPLQEQMLWQFPGLLLGVCFILLARTIDQKVKNAFPIAIIWITLTLFYLNLGHISWRLSFWFILLLLGLLVIKPTLYKKQFIYSWEERIKDGIIIVSLMGVLFYIAGLLFPIRAHITGGSIERLHYIIAWEPIALATLILTLVYLCLVKILQGKSCQIGDVFNVDRYKKLLQAYGGSSDSGLAFLNDKRLYWYQKNGEDCVAFQFVIVNNKCLIMGEPAGDDTYIREAIESFIDDADKLDYDLVFYSIGQKLTLLLHEYGFDFMKVGEDALVNLETFTLKGNKYKPFRNALNRVEKDGFYFEVVQSPHSQELLNSLEEISNTWLEGRPEKGFSLGYFNKDYFQQAPIALVKNAEHEVVAFANIMPNYEKSIISIDLMRHDKQKIPNGVMDFLFLSLFSYYQEKGYHYFDLGMAPLSGVGRVETSFAKERMAYLVYHFGSHFYSFNGLHKYKKKFTPLWSERYISCSRSSWLICAICALLMEDSKIKIVK

SEQ ID NO: 10285 - DNA, 741 bp, Streptococcus agalactiae
atgactgagaactggttacatactaaagatggttcagatatttattatcgtgtcgttggtcaaggtcaaccgattgtttttttacatggcaatagcttaagtagtcgctattttgataagcaaatagcatatttttctaagtattaccaagttattgttatggatagtagagggcatggcaaaagtcatgcaaagctaaataccattagtttcaggcaaatagcagttgacttaaaggatatcttagttcatttagagattgataaagttatattggtaggccatagcgatggtgccaatttagctttagtttttcaaacgatgtttccaggtatggttagagggcttttgcttaattcagggaacctgactattcatggtcagcgatggtgggatattcttttagtaaggattgcctataaattccttcactatttagggaaactctttccgtatatgaggcaaaaagctcaagttatttcgcttatgttggaggatttgaagattagtccagctgatttacagcatgtgtcaactcctgtaatggttttggttggaaataaggacataattaagttaaatcattctaagaaacttgcttcttattttccaaggggggagttttattctttagttggctttgggcatcacattattaagcaagattcccatgtttttaatattattgcaaaaaagtttatcaacgatacgttgaaaggagaaattgttgaaaaagctaat

SEQ ID NO: 10286 - protein, 247 aa, Streptococcus agalactiae
MTENWLHTKDGSDIYYRVVGQGQPIVFLHGNSLSSRYFDKQIAYFSKYYQVIVMDSRGHGKSHAKLNTISFRQIAVDLKDILVHLEIDKVILVGHSDGANLALVFQTMFPGMVRGLLLNSGNLTIHGQRWWDILLVRIAYKFLHYLGKLFPYMRQKAQVISLMLEDLKISPADLQHVSTPVMVLVGNKDIIKLNHSKKLASYFPRGEFYSLVGFGHHIIKQDSHVFNIIAKKFINDTLKGEIVEKAN

SEQ ID NO: 10287 - DNA, 2316 bp, Streptococcus agalactiae
atgttagacgaattaaaagcaatcataaaaagcccaaaattatggattacgatggctggggttgcactgattccaacgctatataatgttatctttctaagctcaatgtgggatccttatgggaatactaaaaatttacctgtggcagtcgttaaccaagataaatcggctaaattaaatggaaaaactatttcaattggcaaagatatggaggacaatttgtctaaaaatgatagcttagatttccattttacaacagctaaaagagcagaaaaagaattagaaaagggtcactattatatggttattacctttcctaaagatctttctagaaaagcgacaactctcatgacagaaaaaccagaaaggttaaatattacttataaaactactaaggggcgtagttttgtagcttcaaaaatgagtgagacagcagctaataaactaaaagatgaggtagcagaatctattacagggacttatactgaatcagtttttaaaaatatgggttctatgaaaacaggtatcaataaagctgctgatgggagtcaagaattattaaatggttctaataagctacaggatgggagccaaaccttgacaagtaatttagatgttttagcaagctctagtcaaactttttctggaggagctaataaactaaatagtggaataaacctttatacagatggtgtggggaccctatctaacgggttagaaacattatcagatggtgttactgcttacacaacaggtgtgcataagttgagtgaaggtagtcaaaaattagatgataagtctcaagcattggtggaaggatcagaaaagttgacggatggtttacaacaattgtcacaagcaactcaactaaaaccagagcaagaacgtactttgcagaacctttcagatggattaaagaatctaaatcagattattacaaatttacaatcgacagcaactactgatagcgatactaatagtaagttatttaattttttatcaactattgaatcaagtacaaaggctttgatgaatacggctgctgctgataaacaaaagcaaatgactgcggtacaatcaacgtcagcttttaaaagtttaacccctgaacaacaatctcaaatcacctcagcggttactggaacacctacttcagctgagacaattgcagcaaatatttcttcaaatatagaaaatatgaaaactgtgcttagtgaagcatctagttcagccccttctaataatggatcacaaaatcttcaaactttgtcaggaacagctaacaatttagtattaaaagctatctcagatttagataaaattcaaaaattgccaacggctactaagcagttatatcaaggtagtcaaaccttgacaaaaggaatcacggattatacgaatgctgtagggcaattacgcaaaggtgcagtaactttagatagtaaatccaatcaattgatttcaggaacacaaaaagcaagtcagggagctcaaactttagatagtaaatcggatcaattgagagacggagcggggcaattagctagtggttctgatagaattgcagatggttctaataagcttgctgggggaggacatcagttgacagatgggttgacagagttgtcaggtggtgtttctcaattatcaagttctttggggaaagctggggaccagttgtccatggtttctgtaaataaagataatgccaatgcagtatctagcccagtcactatcaagcatgaagattatgatagcgttgatacgaatggtgttggaatggcaccatacatgatttcagttgcgttgatggtggtagctttatcagccaatgttatttttgcgaaagctttatctggcaaagagccagctaatcgttttagttgggctaaaaataaattattaatcaatggattcattgcaactctagcagcaactatcttattttttgcagttcaattcataggtcttaaaccagattaccctggaaaaacctactttattatcctattgacagcatggactttgatggcattagtaactgctttagtgggatgggataataggtatggttccttcttgtcgttattaatattattattccagcttggttcaagcgcaggaacttacccaatagaattgagtcctaagttctttcaaacaattcaaccatttttaccgatgacttactctgtttcaggattaagagagaccatctcgttgacgggagacgttaaccatcaatggagaatgctagtaatctttttagtatcatcgatgatacttgctcttcttatttatcgtaaacaagaagat

SEQ ID NO: 10288 - protein, 772 aa, Streptococcus agalactiae
MLDELKAIIKSPKLWITMAGVALIPTLYNVIFLSSMWDPYGNTKNLPVAVVNQDKSAKLNGKTISIGKDMEDNLSKNDSLDFHFTTAKRAEKELEKGHYYMVITFPKDLSRKATTLMTEKPERLNITYKTTKGRSFVASKMSETAANKLKDEVAESITGTYTESVFKNMGSMKTGINKAADGSQELLNGSNKLQDGSQTLTSNLDVLASSSQTFSGGANKLNSGINLYTDGVGTLSNGLETLSDGVTAYTTGVHKLSEGSQKLDDKSQALVEGSEKLTDGLQQLSQATQLKPEQERTLQNLSDGLKNLNQIITNLQSTATTDSDTNSKLFNFLSTIESSTKALMNTAAADKQKQMTAVQSTSAFKSLTPEQQSQITSAVTGTPTSAETIAANISSNIENMKTVLSEASSSAPSNNGSQNLQTLSGTANNLVLKAISDLDKIQKLPTATKQLYQGSQTLTKGITDYTNAVGQLRKGAVTLDSKSNQLISGTQKASQGAQTLDSKSDQLRDGAGQLASGSDRIADGSNKLAGGGHQLTDGLTELSGGVSQLSSSLGKAGDQLSMVSVNKDNANAVSSPVTIKHEDYDSVDTNGVGMAPYMISVALMVVALSANVIFAKALSGKEPANRFSWAKNKLLINGFIATLAATILFFAVQFIGLKPDYPGKTYFIILLTAWTLMALVTALVGWDNRYGSFLSLLILLFQLGSSAGTYPIELSPKFFQTIQPFLPMTYSVSGLRETISLTGDVNHQWRMLVIFLVSSMILALLIYRKQED

SEQ ID NO: 10289 - DNA, 1686 bp, Streptococcus agalactiae
atgggtaaaaacattgataaaacctatatacaaatgaaaatgcttaatacaggtaaggggcctgctgtccgtgccttaagagcacaagctgataaagccctctatgcacaaacaatgaagcaaactgtagaaaagcaagaaaatcttaccttaagacaagctatgattgacgaaatacttgttgaagatggaaaggttgtgggggttcgtacagcaactaatcagaaattttcagcaaaatctgttgttataacaacaggtactgctcttcgaggagagattatattaggtgatcttaagtactcctcgggccctaataatagtttagcttctgtgacattggcagataatttaagagacctaggattagaaattggtcgtttcaaaactggaacacctcctcgtgtaaaagcctcctctattaattatgaaaagacagagatacaacctggggatgagcaaccaaatcatttttcatttatgtctagggatgaagattatattactgaccaggtaccgtgctggttgacctatacgaatactttgagtcatgacatcatcaatcaaaatctacaccgtgctcctatgttttctggaatcgttaagggagttggtcctagatattgtccgtcaattgaagataaaattgtgcgttttgctgataaagagcgccaccaactcttcttagaaccagaaggtagatacactgaagaagtttatgttcaagggctatcaacgagtcttcctgaggatgttcaagttgatttattacgttctataaaagggcttgaaaatgctgaaatgatgcgtacaggctatgctattgagtatgatattgtattgcctcatcaattaagagcaacactcgaaacaaaagtaattgctggtttgtttactgcaggacagactaatggtacttcaggttatgaagaagctgctggtcaagggttggttgctgggatcaacgctgctcttaaagttcaagggaagccagaacttattttaaaacgaagtgatgcttacattggtgtcatgattgatgatttagttaccaaagggactctagaaccatatcgtctgttgacaagtcgcgcagaatatcgtctgattcttcgtcatgataatgcagatatgcgtttaacagaaatcggttatgagattggcctagtagatgaagagcgttatgcgatatttaaaaagcgtcaaatgcaatttgaaaatgaattagaacgtttagactctataaagttaaagccagtttctgagacaaataaacggattcaagaattgggctttaaacctttgacagatgctttaactgccaaagaatttatgcgccgcccacaaatcacatatgcagtagcaacggattttgttggttgtgctgatgagccattagacagtaaggttattgaacttttggaaactgaaattaaatacgaaggctatattaaaaaggctttagatcaagttgcaaaaatgaaacgaatggaagaaaaacgtattccccctcatattgactgggacgacattgattctatcgcaacagaagctagacaaaaattcaaaaaaattaacccagaaacgctaggtcaggctagtcgtatttcaggagttaatccagccgatattagtattttaatggtttaccttgaaggaagacaaaaaggtcgtaaaaatatcaat

SEQ ID NO: 10290 - protein, 562 aa, Streptococcus agalactiae
MGKNIDKTYIQMKMLNTGKGPAVRALRAQADKALYAQTMKQTVEKQENLTLRQAMIDEILVEDGKVVGVRTATNQKFSAKSVVITTGTALRGEIILGDLKYSSGPNNSLASVTLADNLRDLGLEIGRFKTGTPPRVKASSINYEKTEIQPGDEQPNHFSFMSRDEDYITDQVPCWLTYTNTLSHDIINQNLHRAPMFSGIVKGVGPRYCPSIEDKIVRFADKERHQLFLEPEGRYTEEVYVQGLSTSLPEDVQVDLLRSIKGLENAEMMRTGYAIEYDIVLPHQLRATLETKVIAGLFTAGQTNGTSGYEEAAGQGLVAGINAALKVQGKPELILKRSDAYIGVMIDDLVTKGTLEPYRLLTSRAEYRLILRHDNADMRLTEIGYEIGLVDEERYAIFKKRQMQFENELERLDSIKLKPVSETNKRIQELGFKPLTDALTAKEFMRRPQITYAVATDFVGCADEPLDSKVIELLETEIKYEGYIKKALDQVAKMKRMEEKRIPPHIDWDDIDSIATEARQKFKKINPETLGQASRISGVNPADISILMVYLEGRQKGRKNIN

SEQ ID NO: 10291 - DNA, 1119 bp, Streptococcus agalactiae
atgactgataattcaaacattcgtgtcgttgtaggcatgagtggaggtgttgattcatcagtaactgccctgcttttaaaagagcaaggttatgatgttattggtgtttttatgaaaaattgggatgacacagatgaatttggtgtttgtacggctactgaagattataaagatgttgctgctgttgctgatcagatcggcataccatactactctgtcaactttgaaaaagagtattgggacagggttttcgaatattttttagcagaatatcgagcaggtcgtacgccaaatccagatgttatgtgtaataaggaaattaaatttaaagcatttctagattatgcgatgacattaggtgctgactatgtagcaacaggtcattatgcacaagtaacacgtgatgagaacggaatagttcatatgcttagaggagcagataataataaggatcaaacttattttctaagtcaattatctcaggagcaattgcaaaaaacgttatttccacttggtcatttacaaaaaccagaagttcgccgtatagctgaagaagcaggacttgcgaccgctaagaaaaaagactctactggtatttgttttattggagaaaaaaatttcaaggatttcctgggtcaatatttaccggctcaaccaggtcgtatgatgactgttgatggtcgtgacatgggtgaacatgctggtttaatgtattatactattggtcaaagagggggccttggtattggtgggcaacatggtggagataataaaccttggtttgtagttggaaaggatttaagtaaaaacattctttatgtaggtcaaggtttctatcatgactcattgatgtcaactagcttgacagcttctgaaatccactttacacgtgatatgcctaatgaatttaagctagaatgtacagctaagttcagatatcgtcaacctgacagtaaagttacagtttacgtaaaaggtaatcaagcaagggttgtgtttgatgatttacaacgagcaatcacaccaggtcaagctgttgttttttataatgaacaagaatgtttaggcggtgggatgattgatcaggcttatcgtgatgataaaatctgtcaatacatt

SEQ ID NO: 10292 - protein, 373 aa, Streptococcus agalactiae
MTDNSNIRVVVGMSGGVDSSVTALLLKEQGYDVIGVFMKNWDDTDEFGVCTATEDYKDVAAVADQIGIPYYSVNFEKEYWDRVFEYFLAEYRAGRTPNPDVMCNKEIKFKAFLDYAMTLGADYVATGHYAQVTRDENGIVHMLRGADNNKDQTYFLSQLSQEQLQKTLFPLGHLQKPEVRRIAEEAGLATAKKKDSTGICFIGEKNFKDFLGQYLPAQPGRMMTVDGRDMGEHAGLMYYTIGQRGGLGIGGQHGGDNKPWFVVGKDLSKNILYVGQGFYHDSLMSTSLTASEIHFTRDMPNEFKLECTAKFRYRQPDSKVTVYVKGNQARVVFDDLQRAITPGQAVVFYNEQECLGGGMIDQAYRDDKICQYI

SEQ ID NO: 10293 - DNA, 537 bp, Streptococcus agalactiae
atgaagaaagaaaatattccgaatctattaactgtagtcagaattttaatgattccgttatttatagtattaacttcagtaacaacaagtacaacttggcatattgttgcagctattgtatttgctattgcaagtttgaccgattacctagatggttatctagcacgtaaatggcaagtagtaacaaattttgggaaatttgcagacccattagctgataaaatgctagttatgagtgcttttatcatgttagttggactagacttagcaccagcttgggtttcagctattatcatttgtagagagttagcagttacaggtttgcgtttacttttagttgaaacaggtggaacagtacttgctgcagctatgccagggaaaataaagacggctactcaaatgtttgcagttatttttttgttagtacattggatgacacttggtaacatcatgttatacattgctctattctttaccttgtattcaggctacgactattttaaaggtgcaggcttcttatttaaggatacttttaaa

SEQ ID NO: 10294 - protein, 179 aa, Streptococcus agalactiae
MKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 10295 - DNA, 1425 bp, Streptococcus agalactiae
atggaaaaagaaaaaaaattaggtcttttaccactaacaatgcttgtcattggctctcttatcggtggcggaatctttgatttaatgcaaaatatgagttccagagccggtttggtaccaatgcttattgcttgggtaattactgctatcgggatggggactttcgttttaagttttcaaaatttatctgaaaaaaggccggacctaacagctggaatctttagttacgctaaagaggggtttggaaactttatgggatttaactctgcatggggttattggttatcagcttggcttggaaatgttgcctacgctgcactcttattcagttcactcggttatttctttaaattctttggtaatggaaataatatcatctcaattattggagcaagtatagttatttgggttgtccatttcttaattttaagaggtgttaatacagctgcatttattaataccatagttacctttgcaaaattagtacctgttattattttcttaatttcagcgttattagctttcaaatttaacatttttagtcttgatatctggggaaatggattacatcaatcaattttcaaccaagtcaattcaactatgaaaaccgctgtttgggtatttattggtattgagggcgccgttgtcttctcaggtcgtgctaaaaaacactctgatattggtaaagcaagtatcctagcattattcactatgatttcactttatgtattgatttctgttttatcacttggtatcatgtcacgtccagaacttgcaaacttaaaaacaccagctatggcttacgttctagaaaaggctgttggtcactggggcgctatcttagttaaccttggtgttatcatttcagtatttggcgctattcttgcttggactttatttgcagcagaattaccatatcaagctgctaaagaaggtgcttttcctaaattctttgcaaaagaaaataaaaacaaagctccaatcaattcactcttagtcactaatctttgtgtacaagcattcttaatcacgttcttattcacacaaagtgcttatcgttttggtttcgcattagcatcatctgctatcttaattccttatgcttttacagcactatatcaattacaattcacactccgtgaggataagtcaactccaggacatcaaaagaatttaattatcggtatcctcgctacaatctatgctgtttaccttatctacgctggtggttttgattacttacttttgacaatgattgcttacactctaggtatgattctctatattaaaatgagaaaagatgacaagcttcctatctttgtgggatatgaaaaaattagtgccattgtcattctagcgctttgcttattatgtattattgaaattatgactggacaaattgacattgctgcaatcctagcaggt

SEQ ID NO: 10296 - protein, 475 aa, Streptococcus agalactiae
MEKEKKLGLLPLTMLVIGSLIGGGIFDLMQNMSSRAGLVPMLIAWVITAIGMGTFVLSFQNLSEKRPDLTAGIFSYAKEGFGNFMGFNSAWGYWLSAWLGNVAYAALLFSSLGYFFKFFGNGNNIISIIGASIVIWVVHFLILRGVNTAAFINTIVTFAKLVPVIIFLISALLAFKFNIFSLDIWGNGLHQSIFNQVNSTMKTAVWVFIGIEGAVVFSGRAKKHSDIGKASILALFTMISLYVLISVLSLGIMSRPELANLKTPAMAYVLEKAVGHWGAILVNLGVIISVFGAILAWTLFAAELPYQAAKEGAFPKFFAKENKNKAPINSLLVTNLCVQAFLITFLFTQSAYRFGFALASSAILIPYAFTALYQLQFTLREDKSTPGHQKNLIIGILATIYAVYLIYAGGFDYLLLTMIAYTLGMILYIKMRKDDKLPIFVGYEKISAIVILALCLLCIIEIMTGQIDIAAILAG

SEQ ID NO: 10297 - DNA, 1359 bp, Streptococcus agalactiae
atgacggaaaacgaacaactattttggaatagagtactagagctatctcgttctcaaatagcaccagcagcttatgaattttttgttctagaggctagactcctcaaaattgaacatcaaactgcagttattactttagataacattgaaatgaaaaagctattctgggaacaaaatttggggcctgttatcctaacagctggttttgaaattttcaatgctgaaattacagctaactatgtctcaaacgatttacatttacaagaaactagtttttctaactaccagcaatctagcaatgaagtaaatactttaccaattagaaaaatcgactctaaccttaaagagaaatatacttttgctaattttgttcaaggagatgaaaatagatgggctgtttcagcatcaattgctgtagctgatagtcctggcacgacttataatcctctatttatctgggggggacctggtctaggaaagacgcatctactaaatgctattggaaatcaagtcttaagagataatccaaacgcgagggttttatacatcactgctgagaattttattaatgaatttgtcagtcatattcgtttagattcgatggaagaattaaaagaaaagtttcgcaacttagacttactcctgattgatgatattcagtcgcttgctaagaaaaccttaggggggacccaagaggagttcttcaatactttcaatgctttacatacaaacgataaacaaatcgtattgaccagtgaccgaaatccaaatcaattaaatgatctagaagaacgtctagtcacgcgctttagttggggactcccagtaaatatcacaccacctgattttgaaacacgagttgctattttaaccaataaaattcaagaatatccttatgattttcctcaagataccattgaatacttagcaggagaatttgattccaacgtacgtgaattagaaggagccttgaaaaatattagtctagttgctgactttaagcatgctaaaactattacagtagatatagctgcagaagctatcagagcacgtaaaaatgatggtcctattgttactgtcattcctatagaagaaattcaaatacaagttggtaaattctatggcgtaactgtaaaagagataaaagcaactaaaagaacacaagatattgtccttgcaagacaggtagccatgtacttagctcgtgagatgacagataacagtctcccaaaaataggtaaagaatttgggggacgagatcactcaactgttctccacgcttataataaaataaaaaatatggttgctcaagatgacaacttacgaattgagatagaaactatcaaaaataaaatcaga

SEQ ID NO: 10298 - protein, 453 aa, Streptococcus agalactiae
MTENEQLFWNRVLELSRSQIAPAAYEFFVLEARLLKIEHQTAVITLDNIEMKKLFWEQNLGPVILTAGFEIFNAEITANYVSNDLHLQETSFSNYQQSSNEVNTLPIRKIDSNLKEKYTFANFVQGDENRWAVSASIAVADSPGTTYNPLFIWGGPGLGKTHLLNAIGNQVLRDNPNARVLYITAENFINEFVSHIRLDSMEELKEKFRNLDLLLIDDIQSLAKKTLGGTQEEFFNTFNALHTNDKQIVLTSDRNPNQLNDLEERLVTRFSWGLPVNITPPDFETRVAILTNKIQEYPYDFPQDTIEYLAGEFDSNVRELEGALKNISLVADFKHAKTITVDIAAEAIRARKNDGPIVTVIPIEEIQIQVGKFYGVTVKEIKATKRTQDIVLARQVAMYLAREMTDNSLPKIGKEFGGRDHSTVLHAYNKIKNMVAQDDNLRIEIETIKNKIR

SEQ ID NO: 10299 - DNA, 780 bp, Streptococcus agalactiae
gtgttctatacagaacagaaagatgatgaaaaaaaacaagtcattaatatactaaggtcttttaaagaaagtgatcatctaatgattataggaggagatggtaccttatcaaaagtaatgacttatctcccccaacatattccgtgcacttattatcctgttggttcgggaaatgattttgccagagctttgaaaattcctaacctcaaagaaacccttaccgctattcagacagaaagattaaaggaaattaattgctttatttatgataaagggctgattttgaatagtttagatttaggttttgcagcctatgtcgtttggaaagcatctaactctaaaataaaaaatattttgaatagatatcgtctaggaaaaataacttacattgttatagctatcaaatcattattacattcttctaaagtacaagtattagtggaaggagagacaggacagcagataaaactaaatgacctttattttttcgcattagcaaataacacttattttggaggtggcattactatttggcctaaagcaagtgctttaactgcagagttagatatggtttacgctaaagggcatacttttctaaaacgattaagtattttattatctttggtttttaaaaggcatactacctctaaaagtataaaacaccagactttcaaagctatgaccgtatattttcctaaaaatagtttgattgaaatagatggcgaaatagttgagttagatcagattagtttaaaatgtcaaaaaaggtatttatatatg

SEQ ID NO: 10300 - protein, 260 aa, Streptococcus agalactiae
MFYTEQKDDEKKQVINILRSFKESDHLMIIGGDGTLSKVMTYLPQHIPCTYYPVGSGNDFARALKIPNLKETLTAIQTERLKEINCFIYDKGLILNSLDLGFAAYVVWKASNSKIKNILNRYRLGKITYIVIAIKSLLHSSKVQVLVEGETGQQIKLNDLYFFALANNTYFGGGITIWPKASALTAELDMVYAKGHTFLKRLSILLSLVFKRHTTSKSIKHQTFKAMTVYFPKNSLIEIDGEIVELDQISLKCQKRYLYM

SEQ ID NO: 10301 - DNA, 573 bp, Streptococcus agalactiae
atggtaaaaatgattgttggattaggaaatccaggaagtaaatataatgatacaaaacataatattggatttatggctgttgacagaattgtaaaagaccttgacgtcaactttacagaagataaaaattttaaagcagagataggtagtgattttatcaacggtgaaaaaatttattttatcaaaccgactacttttatgaataacagtggtattgctgtaaaagccctgcttacttactacaacatttctattaaggatatgattatcatatatgatgatttagacatggaagtcggtaaaatacgttttcgtcaaaaaggatctgctgggggacataatggtatcaagtctattattgctcatttaggtactcaagaatttgatcgtattaaagtaggtataggacgtccgaatggacgtatgacagttattaatcatgttctagggaaatttgataaaaatgatgaaattatgatattaaatacccttgataaggttgacaatgctgtcaattattatttacagacgaatgattttcaaaaaacaatgcagaaatacaacggtttaaaa

SEQ ID NO: 10302 - protein, 191 aa, Streptococcus agalactiae
MVKMIVGLGNPGSKYNDTKHNIGFMAVDRIVKDLDVNFTEDKNFKAEIGSDFINGEKIYFIKPTTFMNNSGIAVKALLTYYNISIKDMIIIYDDLDMEVGKIRFRQKGSAGGHNGIKSIIAHLGTQEFDRIKVGIGRPNGRMTVINHVLGKFDKNDEIMILNTLDKVDNAVNYYLQTNDFQKTMQKYNGLK

SEQ ID NO: 10303 - DNA, 150 bp, Streptococcus agalactiae
ttggtaactgttgtcataacatatcctctaaataaaatttcctctgtcaagctttggataaagtatgcaagaaataaaaagaaaaaaggtccaaaagaaaaggaattgctggaagaaatttccacaaaacctgataaccagtggcaaata

SEQ ID NO: 10304 - protein, 50 aa, Streptococcus agalactiae
MVTVVITYPLNKISSVKLWIKYARNKKKKGPKEKELLEEISTKPDNQWQI

SEQ ID NO: 10305 - DNA, 114 bp, Streptococcus agalactiae
gtgactactttaacacttgccactctaggggctgctacagttcttaccggtgctactttagctactggagctggtgtttcagcggcaacagaagctggtgatactgttgttgac

SEQ ID NO: 10306 - protein, 38 aa, Streptococcus agalactiae
MTTLTLATLGAATVLTGATLATGAGVSAATEAGDTVVD

SEQ ID NO: 10307 - DNA, 183 bp, Streptococcus agalactiae
ttgttacgcctttttgttattgactgtgatgacgagcatatacctatttcctatggctgcccgctacgaaatgtctcttttagataccgtgaaaaagagctttataatggcatgtttaaacttgaaatggactggtgtattgatgtttttattaatcatgacttggtttattatggtgcagtc

SEQ ID NO: 10308 - protein, 61 aa, Streptococcus agalactiae
MLRLFVIDCDDEHIPISYGCPLRNVSFRYREKELYNGMFKLEMDWCIDVFINHDLVYYGAV

SEQ ID NO: 10309 - DNA, 435 bp, Streptococcus agalactiae
atgaagaaagtctgttttgtttgtcttggaaatatctgccgtagcccgatggctgagtttgttatggcgaatttagataaggaggatagcctcttggttgagagtcgtgcgacttcaacatgggagcatggaaatcctatacataggggaacgcaagcgattttgcagcgttatcaaattccttacattaacgataaagggtcacaacctatttctaaagacgatttagcatattttgattatatcatcggtatggatgagcaaaatgtcaaggatttaaaagctctatcacaaggaacctatgatgataagattagtcttttttgtgatggtggtgttcctgatccatggtatactggtgattttgaggaaacctatcgtctagtcaatgatggctgtaaacagtggttaacgctaataaataatagtagagat

SEQ ID NO: 10310 - protein, 145 aa, Streptococcus agalactiae
MKKVCFVCLGNICRSPMAEFVMANLDKEDSLLVESRATSTWEHGNPIHRGTQAILQRYQIPYINDKGSQPISKDDLAYFDYIIGMDEQNVKDLKALSQGTYDDKISLFCDGGVPDPWYTGDFEETYRLVNDGCKQWLTLINNSRD

SEQ ID NO: 10311 - DNA, 117 bp, Streptococcus agalactiae
atggggcttaacggtatggctcttatcgaaaagatcaaaagatcaaaagcaattgagggggactttgttccttatttccatgggaatttttggagtcagcttccttaccatgtttgt

SEQ ID NO: 10312 - protein, 39 aa, Streptococcus agalactiae
MGLNGMALIEKIKRSKAIEGDFVPYFHGNFWSQLPYHVC

SEQ ID NO: 10313 - DNA, 321 bp, Streptococcus agalactiae
ttgttgattggtgaagctgaacctttcgcacgtggacggaaacgtttcattgttggtccttcgttagcgaatgtttcagatactaccaagtttgctttttccaaaccaaagttgttttctgcatttgcaattgctgagttaagagttttctcaataacacgagctgctttgtttggagtgaattttaagattgcgattgcgtcagcaacattcttaccacggataagatcaagtactaaacgtgttttacgaggtgaaacacgcactgtacgagccattgctttagctgaagtaatttctgccattgtgtcctcctcctat

SEQ ID NO: 10314 - protein, 107 aa, Streptococcus agalactiae
MLIGEAEPFARGRKRFIVGPSLANVSDTTKFAFSKPKLFSAFAIAELRVFSITRAALFGVNFKIAIASATFLPRIRSSTKRVLRGETRTVRAIALAEVISAIVSSSY

SEQ ID NO: 10315 - DNA, 114 bp, Streptococcus agalactiae
atgaaggtaagaccatcggttaaaccaatttgcgaatactgtaaagttattcgtcgtaacggtcgtgttatggtaatttgtccgacaaacccaaaacacaaacaacgtcaagga

SEQ ID NO: 10316 - protein, 38 aa, Streptococcus agalactiae; identical to SEQ ID NO: 7244

SEQ ID NO: 10317 - DNA, 363 bp, Streptococcus agalactiae
atggctcgtattgctggagttgatattccaaatgacaaacgtgtagtaatttcacttacttatgtatacggaattggtctttctacatctaaaaaaatcttagcagctgcaggtatttctgaagatatccgcgttaaagatttgacaccagatcaagaggacgctatccgtcgtgaagttgatgcaatcaaagttgaaggtgacctacgtcgtgaggtaaacttgaatattaaacgtttgatggaaatcggttcataccgtggaatccgtcaccgtcgtggacttcctgtccgtggacaaaatactaaaaataacgctcgcactcgtaaaggtaaagctgttgcgattgcaggtaagaaaaaa

SEQ ID NO: 10318 - protein, 121 aa, Streptococcus agalactiae
MARIAGVDIPNDKRVVISLTYVYGIGLSTSKKILAAAGISEDIRVKDLTPDQEDAIRREVDAIKVEGDLRREVNLNIKRLMEIGSYRGIRHRRGLPVRGQNTKNNARTRKGKAVAIAGKKK

SEQ ID NO: 10319 - DNA, 120 bp, Streptococcus agalactiae
ttggatgacttgtgggtagcggagaaattccaaacgaacttggagatagctggttctctccgaaatagctttagggctagcgtcgatgttaagtctcttggaggtagagcactgtttggg

SEQ ID NO: 10320 - protein, 40 aa, Streptococcus agalactiae
MDDLWVAEKFQTNLEIAGSLRNSFRASVDVKSLGGRALFG

SEQ ID NO: 10321 - DNA, 93 bp, Streptococcus agalactiae
ttgactagagaagctggtattatttatcaatcatgtgttttgggttttacccgtaaactaactgttagattaacatttaatttaaggagtttt

SEQ ID NO: 10322 - protein, 31 aa, Streptococcus agalactiae
MTREAGIIYQSCVLGFTRKLTVRLTFNLRSF

SEQ ID NO: 10323 - DNA, 96 bp, Streptococcus agalactiae
gtgaacatagtatcacagctttatgacttgaatatgacctctaaaaataatgatattttatcattaaattatttaaaaaatagcttgacaattttt

SEQ ID NO: 10324 - protein, 32 aa, Streptococcus agalactiae
MNIVSQLYDLNMTSKNNDILSLNYLKNSLTIF

SEQ ID NO: 10325 - DNA, 96 bp, Streptococcus agalactiae
ttgcattatctaaaaggtttatccaaacttgcatcagcaagtcagagtttgagtaaacagtatatggttttgaatccagttgaaaatttatccttt

SEQ ID NO: 10326 - protein, 32 aa, Streptococcus agalactiae
MHYLKGLSKLASASQSLSKQYMVLNPVENLSF

SEQ ID NO: 10327 - DNA, 915 bp, Streptococcus agalactiae
atgacacgtaaaattggaattataggcatggggcacgttggatcaactgttgcacacgctcttattgcacaaggtattggtgatgattatgtctttattgatactaatgttgataaggttaatgctgatatgattgattttcaagatgctctggcaaatgctacttatcacgctaatctagtattaaacgactatgacgcgttgtcagatgctgatgttgtgatttcagccttaggtgatatttcactacagaataacaaagaagctaatcgctttgctgaactaccatttaccagtaaagaagtctacgacgttagccaaaagttaaaatcatctggttttagagggatccttattgtcgttactaatcctgttgatgccattacccagctttatcaagaatatactcaatttcctaaatcacgcgttatcggaacaggaaccttattggatactgctcggatgaaaagagtgcttggtcaacgcctacaagttgatccaaggagtatcggtggttataatctaggagagcatggtaactcccaatttgtcgcttggagtcaggtaactgtaaaaggacaaccagctatatcactattaaaagcagaagaattagaacagataaaagaagcttctttaaaaggcgggcacactgtcttttttggtaaaaaatatactagttatggtatcgctaccgcagctgtccgcatcgttttaactgtgttaaatgattcccatgagttactacctgtatctaccttctatgagtccgaaggggtttaccttggatatccagctattattggtagagtaggaattgtagaaagaatttctctttcactaagcccaaaagaagagcaacaactcacagattcagcggcatttattcgaaattatcttaagcatatcaatctt

SEQ ID NO: 10328 - protein, 305 aa, Streptococcus agalactiae
MTRKIGIIGMGHVGSTVAHALIAQGIGDDYVFIDTNVDKVNADMIDFQDALANATYHANLVLNDYDALSDADVVISALGDISLQNNKEANRFAELPFTSKEVYDVSQKLKSSGFRGILIVVTNPVDAITQLYQEYTQFPKSRVIGTGTLLDTARMKRVLGQRLQVDPRSIGGYNLGEHGNSQFVAWSQVTVKGQPAISLLKAEELEQIKEASLKGGHTVFFGKKYTSYGIATAAVRIVLTVLNDSHELLPVSTFYESEGVYLGYPAIIGRVGIVERISLSLSPKEEQQLTDSAAFIRNYLKHINL

SEQ ID NO: 10329 - DNA, 186 bp, Streptococcus agalactiae
atggctaaagtatgttatttcacaggacgtaaaacagtttctggtaacaaccgttcacacgcgatgaaccaaacaaaacgtactgttaaaccaaaccttcaaaaagttactgttcttatcgacggtaaaccaaaaaaagtttgggtttcagctcgtgcgcttaaatctggtaaagtagaacgcgtt

SEQ ID NO: 10330 - protein, 62 aa, Streptococcus agalactiae
MAKVCYFTGRKTVSGNNRSHAMNQTKRTVKPNLQKVTVLIDGKPKKVWVSARALKSGKVERV

SEQ ID NO: 10331 - DNA, 363 bp, Streptococcus agalactiae
atgactgtaaaaatcaatacaagagatggtcaaattgaactctctgatgacgttattgcaactgtcgttggaggttcagcaacggaaatttttggcgttgttggtatggcaagtaaaagtgctatcaaagataactttcaagcacttttgcgtaaggaaaactacgcaaaaggtgttgttgtgaggtctagtgaagcgggcatcgtagtagatgtttatactgtcatgagttacggcgtcaaaattagtgaagtttcaaaaaatattcaagagcgagtgaaattcaatctcgaaaatcagcttggtttatctgctgatatggtgaatgtttatgtgcaaagtattaaggttgtaggagaagat

SEQ ID NO: 10332 - protein, 121 aa, Streptococcus agalactiae
MTVKINTRDGQIELSDDVIATVVGGSATEIFGVVGMASKSAIKDNFQALLRKENYAKGVVVRSSEAGIVVDVYTVMSYGVKISEVSKNIQERVKFNLENQLGLSADMVNVYVQSIKVVGED

SEQ ID NO: 10333 - DNA, 93 bp, Streptococcus agalactiae
ttgtatgaatgttttaaaacaattctaacacaatttgtcaaaattttcaaaatactgatgctttatcatactaaaatagaaactctgataaaa

SEQ ID NO: 10334 - protein, 31 aa, Streptococcus agalactiae
MYECFKTILTQFVKIFKILMLYHTKIETLIK

SEQ ID NO: 10335 - DNA, 114 bp, Streptococcus agalactiae
atggctgaaaaaacagacctatcgtcagcctatcgcagacttaaaagtcctaacattaaaactagaaaacgtgctctgaaaatcattcatgagtacaaacgttacggtaaaaaa

SEQ ID NO: 10336 - protein, 38 aa, Streptococcus agalactiae; identical to SEQ ID NO: 7390

SEQ ID NO: 10337 - DNA, 288 bp, Streptococcus agalactiae
atgaaacttaaaatcagtgttttaacagcagcttcagctgtcactctattattagctactttagcaagtcttgcgaaggcagacacagtgtcttatccttcacgtgatgccggatttgtctactctcgtgggtatgcgccttctgaatcaagctatccttcacgcgatgccgggtttatctactctcgtgggtatgcgccttctgaatcaagctatccttcacgcgatgccggatttatctactctcgtgggtatgctccaaaacacttcctaagtgcttacgataaa

SEQ ID NO: 10338 - protein, 96 aa, Streptococcus agalactiae; identical to SEQ ID NO: 9020

SEQ ID NO: 10339 - DNA, 105 bp, Streptococcus agalactiae
gtgtctgccttcgcaagacttgctaaagtagctaataatagagtgacagctgaagctgctgttaaaacactgattttaagtttcattataaaatcctttcaaaga

SEQ ID NO: 10340 - protein, 35 aa, Streptococcus agalactiae
MSAFARLAKVANNRVTAEAAVKTLILSFIIKSFQR

SEQ ID NO: 10341 - DNA, 228 bp, Streptococcus agalactiae
atgaaaaataatgttgttacaacaaaggagagaaatattgctaaaccaccactacttggcattggtactttgttgattcttcgagcgttcggtttatcaaccgctcctaccttcaaagatataactcgaataataggagttagaatgattgataataaaaatgctccaatcaatacaaaaatatactcaattgtaaaaggtatcattttatcccatctcaatcatttg

SEQ ID NO: 10342 - protein, 76 aa, Streptococcus agalactiae
MKNNVVTTKERNIAKPPLLGIGTLLILRAFGLSTAPTFKDITRIIGVRMIDNKNAPINTKIYSIVKGIILSHLNHL

SEQ ID NO: 10343 - DNA, 132 bp, Streptococcus agalactiae
atgaacaatgttcctgagaacctagttactatgaccaaatatctaaatacaggatttagcgaaaataatcctgatggtatgttatactacgaaaatagattagatagttggttggcaaatcataaaaatttc

SEQ ID NO: 10344 - protein, 44 aa, Streptococcus agalactiae
MNNVPENLVTMTKYLNTGFSENNPDGMLYYENRLDSWLANHKNF

SEQ ID NO: 10345 - DNA, 135 bp, Streptococcus agalactiae
atgtcaaggatgtggactattgatttttgtccaccaatcgtttaccagcaatatgtttttatcattactattagtattagcattgcgatgtctatttttgctatttatcgctatgcttcattgaagaaaacgata

SEQ ID NO: 10346 - protein, 45 aa, Streptococcus agalactiae
MSRMWTIDFCPPIVYQQYVFIITISISIAMSIFAIYRYASLKKTI

SEQ ID NO: 10347 - DNA, 237 bp, Streptococcus agalactiae
atgaaagaaaaattattagtacctgctttaaattgtttgctaggtctactcttcctaggtgatcactggtttttatttcgtcttcaaaatggagaactttttgctattgtgacgctaatactgctttgcacaacttcatttttaatcaataagaatcaccccaaaaatttgactttaattgctatggttatcacttttttagccgtattatcttttctatctacctttttattagct

SEQ ID NO: 10348 - protein, 79 aa, Streptococcus agalactiae
MKEKLLVPALNCLLGLLFLGDHWFLFRLQNGELFAIVTLILLCTTSFLINKNHPKNLTLIAMVITFLAVLSFLSTFLLA

SEQ ID NO: 10349 - DNA, 96 bp, Streptococcus agalactiae
atgataaacgacaacaacaattggttttacaaagttatcaaaaatgtttttagacgatggtttttatcttatggcttgaaagtgtttttggaaagc

SEQ ID NO: 10350 - protein, 32 aa, Streptococcus agalactiae
MINDNNNWFYKVIKNVFRRWFLSYGLKVFLES

SEQ ID NO: 10351 - DNA, 117 bp, Streptococcus agalactiae
ttggaaaatgtttttgttgctggcgcatttgccctcataggaataactattttattgatgcttttactaggaaggttgatattgctacttatttttcaaggggagatgatgcaattt

SEQ ID NO: 10352 - protein, 39 aa, Streptococcus agalactiae
MENVFVAGAFALIGITILLMLLLGRLILLLIFQGEMMQF

SEQ ID NO: 10353 - DNA, 99 bp, Streptococcus agalactiae
atggagaagtttttccgaaacggtatcaaaaaaggtatcaaaagcaaaaaacgacaaaaaaagcaccttgcaagagacttgcaaaatgcttgtaatcgt

SEQ ID NO: 10354 - protein, 33 aa, Streptococcus agalactiae
MEKFFRNGIKKGIKSKKRQKKHLARDLQNACNR

SEQ ID NO: 10355 - DNA, 324 bp, Streptococcus agalactiae
atggactatgataacgacagctatcttatcccgaaagttttactgcaagatgatttctacagtagtctatctgcgagagatattttagtctatgctgtcttgaaagatagacagatagaagctcctgaaaaaggttggatagatactgatggcagtatatatctaaattttaaactgattgaattagctaaaatgttttcttgcagcagaacgacaatgatagatattatgcaacgactggaagaagttaatttgattgaacgagaaagagtagatgttttttatggctactctttaccctacaaaacctatatcaacgaggta

SEQ ID NO: 10356 - protein, 108 aa, Streptococcus agalactiae
MDYDNDSYLIPKVLLQDDFYSSLSARDILVYAVLKDRQIEAPEKGWIDTDGSIYLNFKLIELAKMFSCSRTTMIDIMQRLEEVNLIERERVDVFYGYSLPYKTYINEV

SEQ ID NO: 10357 - DNA, 123 bp, Streptococcus agalactiae
atgatattacaaataaaagaaaatgactatatatcagctcatatattggttaaagttggtaaatataaattattgaaattacctcataagtttaccaatgagattacggttagaaaggaatac

SEQ ID NO: 10358 - protein, 41 aa, Streptococcus agalactiae
MILQIKENDYISAHILVKVGKYKLLKLPHKFTNEITVRKEY

SEQ ID NO: 10359 - DNA, 111 bp, Streptococcus agalactiae
ttgcttcctcttaataggatattagctactggcctagaagtacatcatgatatttgtagaaattgtggtactattgctagaagttatataaatgacttggagaaattgaaa

SEQ ID NO: 10360 - protein, 37 aa, Streptococcus agalactiae
MLPLNRILATGLEVHHDICRNCGTIARSYINDLEKLK

SEQ ID NO: 10361 - DNA, 489 bp, Streptococcus agalactiae
atgtcaattttagatgactatgaaaaagaattactagttatttcacatcaaataatagcttaccttattaagtcaggtgttaatcctagtcaagcacaggatgttactcaagacgtctttttacaaatactagaatctgatttctcccttccacttgataaaataaaagcttggatgtatcgtactacaattaggaggtatattgatctttatcgaagaaataaacgctataacgaaatcctgcaaaaagaattctttatagaaaataatttgtattacaccgaatcagagaagttttttgaattacatgaagcaatattacacttgaagaaagattatcaaactttaatagatttatattattttaatgatttttcaattaaagaaatatctgaaattactggacaatcacaaagtacaattaaaataagacttatgcgagctagaagagaagttaaaaaatatttagaaaaggataattttaaaata

SEQ ID NO: 10362 - protein, 163 aa, Streptococcus agalactiae
MSILDDYEKELLVISHQIIAYLIKSGVNPSQAQDVTQDVFLQILESDFSLPLDKIKAWMYRTTIRRYIDLYRRNKRYNEILQKEFFIENNLYYTESEKFFELHEAILHLKKDYQTLIDLYYFNDFSIKEISEITGQSQSTIKIRLMRARREVKKYLEKDNFKI

SEQ ID NO: 10363 - DNA, 309 bp, Streptococcus agalactiae
atgattccatcgcaaatgctaaaaggattacttgaaggagctatcctaaaaatcatacagcaagaggagacttatgcttatgaaatctcaaaaaaattaaattcttatggttttggagaaatttccgaagggacaatctaccccattatcttaagactacaaagcaataaatatataaaaggacaacaaaagccttcccctcaaggacctaagcgtaaatattatacgttaaccaatgaaggcgtggagcaattagcccaatttaaacagaattgggagtcacttagtaaagcattaaacaaactactc

SEQ ID NO: 10364 - protein, 103 aa, Streptococcus agalactiae
MIPSQMLKGLLEGAILKIIQQEETYAYEISKKLNSYGFGEISEGTIYPIILRLQSNKYIKGQQKPSPQGPKRKYYTLTNEGVEQLAQFKQNWESLSKALNKLL

SEQ ID NO: 10365 - DNA, 261 bp, Streptococcus agalactiae
atgattgaattactattagcattactgttatggaatattttagtatttgcaacctatgctattgataaaaggcgtgcaattagaggggcatggcgtattagtgagaaaacattgatgatagagagtttattattagggggatttggtgcattcctaggtggagaagtttttcgtcataaaacgactaaatggtatttcagactagtttggtatatcggaatgattattgatttagctattatttggctaatttggtgttat

SEQ ID NO: 10366 - protein, 87 aa, Streptococcus agalactiae
MIELLLALLLWNILVFATYAIDKRRAIRGAWRISEKTLMIESLLLGGFGAFLGGEVFRHKTTKWYFRLVWYIGMIIDLAIIWLIWCY

SEQ ID NO: 10367 - DNA, 129 bp, Streptococcus agalactiae
ttggtcaatggtatggaatactgtagctgtcaatatcataatccttatcattgggttgctcatattatcaatttgccaatacttactgctaaaaaatttttggaagaagcttgtttagtaaaaaggttt

SEQ ID NO: 10368 - protein, 43 aa, Streptococcus agalactiae
MVNGMEYCSCQYHNPYHWVAHIINLPILTAKKFLEEACLVKRF

SEQ ID NO: 10369 - DNA, 246 bp, Streptococcus agalactiae
ttgacaatcgcttgttggatagagatgtttttagaaatagcaaaagtttatttacaaggtttagggcttgccagcataactgttattttagttggtataatttgggtcttttggcgtgccaagaaaaacatagataaaacagctagagaacgccaatctgttctttatgatgtccttctgatagctcttatgacagctccaatacttgcctttgcatttgtagctatcattttaatgataaaagct

SEQ ID NO: 10370 - protein, 82 aa, Streptococcus agalactiae
MTIACWIEMFLEIAKVYLQGLGLASITVILVGIIWVFWRAKKNIDKTARERQSVLYDVLLIALMTAPILAFAFVAIILMIKA

SEQ ID NO: 10371 - DNA, 120 bp, Streptococcus agalactiae
atgaaatatatgaggaatgatcgttttttcggatatgagaacgttttacgcttgatttttccatttaatttaggtattatttactttgatataaaggataggacttatattaaaacgatt

SEQ ID NO: 10372 - protein, 40 aa, Streptococcus agalactiae
MKYMRNDRFFGYENVLRLIFPFNLGIIYFDIKDRTYIKTI

SEQ ID NO: 10373 - DNA, 99 bp, Streptococcus agalactiae
ttgtcatattttgaaatgacaaaaatatctaaaaagtttacttctgattttttatactatgattatagtaaaggagaaccaaatggcaaaagatataat

SEQ ID NO: 10374 - protein, 33 aa, Streptococcus agalactiae
MSYFEMTKISKKFTSDFLYYDYSKGEPNGKRYN

SEQ ID NO: 10375 - DNA, 108 bp, Streptococcus agalactiae
atggcatctcgactggaaaaaaactatcacagccaatccttttctcgtgctattttaagtgcctccaaacgattattaactcctaatttatcaaaaatatttgacgtg

SEQ ID NO: 10376 - protein, 36 aa, Streptococcus agalactiae
MASRLEKNYHSQSFSRAILSASKRLLTPNLSKIFDV

SEQ ID NO: 10377 - DNA, 90 bp, Streptococcus agalactiae
atggacttgcgaaaactttcattctcaacctctttcttctttaaaaaattttatgttaaagatacagcctcaaaagttggcgttctctgt

SEQ ID NO: 10378 - protein, 30 aa, Streptococcus agalactiae
MDLRKLSFSTSFFFKKFYVKDTASKVGVLC

SEQ ID NO: 10379 - DNA, 150 bp, Streptococcus agalactiae
atgggtaaagataaatggactcataaacaaacgtctctgcaaaatctcttacaaaatattttactattagtgggtggagatgacagagataaactcccaaggttgaaggggctaatacaacaattattttctttaagaatcccgagggct

SEQ ID NO: 10380 - protein, 50 aa, Streptococcus agalactiae
MGKDKWTHKQTSLQNLLQNILLLVGGDDRDKLPRLKGLIQQLFSLRIPRA

SEQ ID NO: 10381 - DNA, 255 bp, Streptococcus agalactiae
ttgtcattctctctatctttgatatactttattaactattataacaaaataagaaagggaaggtctattcttatggataattgtactttagaattcccttatagttttgaaaataactttaaacctattttgtccgcttttacatctaatgaaatgccaagctaccccatgctcccattatgtttacaaaaagcacctccatcactcatcggacaaaaaaagacacctcaaaaaggtgtctttttagtatcaata

SEQ ID NO: 10382 - protein, 85 aa, Streptococcus agalactiae
MSFSLSLIYFINYYNKIRKGRSILMDNCTLEFPYSFENNFKPILSAFTSNEMPSYPMLPLCLQKAPPSLIGQKKTPQKGVFLVSI

SEQ ID NO: 10383 - DNA, 537 bp, Streptococcus agalactiae
atgtttcacacaaaaagcctaatccagatggctatgatggctactttattggtggtacttggtttcattcctgctctaccacttggtttcattccggtccctatcgtcttacaaaacctaggggttatgatggctggtgttattttgggcggaagaaaagggagtttatctattttgctcttctttcttgtcggtttagttattcctgtattctcaggtttacgttcgactatacctgtattgacaggaccaacagctggttatgttattgcttggttgtttgttcctttgcttatctcatatggtgtaaaattagtaaataaaaagaattttatagctattttccttattgtatggctagcaggggtcctttttgtagatgtagcaggagcagtttggctggcatcttatacgaacatcccattagataaatcacttcttcaaaacttagtatttatcccaggagatacaataaaagccattatagctgctgttgttgctgttaaatataaagatagttttttcttgactgaaaaa

SEQ ID NO: 10384 - protein, 179 aa, Streptococcus agalactiae
MFHTKSLIQMAMMATLLVVLGFIPALPLGFIPVPIVLQNLGVMMAGVILGGRKGSLSILLFFLVGLVIPVFSGLRSTIPVLTGPTAGYVIAWLFVPLLISYGVKLVNKKNFIAIFLIVWLAGVLFVDVAGAVWLASYTNIPLDKSLLQNLVFIPGDTIKAIIAAVVAVKYKDSFFLTEK

SEQ ID NO: 10385 - DNA, 774 bp, Streptococcus agalactiae
atgaaattaacaacgttaggttgttggggtggttatccttataaagatggaggaaccacaagttttctattaactggagaaaataattttcacttattaatagatgcgggaagtcgttcaatcaatgagctagaaaaagaaataagcccgttggatttggatgcagttatcatcagtcattatcatccagatcatgtagcagatttgggtgtgttgtatcattatcgtttgctataccctaaagataaatgggaacccaaagtattgccagtttatggacataatgaggatgattatgagttttctaaattgacattacctaacgttgctcaaggaattgcttatcataccaatggagttgagcaagttggtcccttcaatattacgtttatcaaaacagtccacccagtcgtctgctatgccatgaggattacagaaagagaaactggtcaagtattagtctttacaggagattctgggtattttgctgaccttgtaccttttacaaaaggcgcagatttatttttagcagacgtttatctttacgagggaaatgaaaatcatattgcacatttgactagtaaagaagcaggtgagattgcttataacgctaaagttaagaaattagttttaacacatgttccgcagtttccgggagaaggaataaaccccgaaaatcatttggaagaacttcgactacagtctgaaaagtatgcaggtggcatctctgttgatttagctcagccacataaatcttgggacttaggaaaacta

SEQ ID NO: 10386 - protein, 258 aa, Streptococcus agalactiae
MKLTTLGCWGGYPYKDGGTTSFLLTGENNFHLLIDAGSRSINELEKEISPLDLDAVIISHYHPDHVADLGVLYHYRLLYPKDKWEPKVLPVYGHNEDDYEFSKLTLPNVAQGIAYHTNGVEQVGPFNITFIKTVHPVVCYAMRITERETGQVLVFTGDSGYFADLVPFTKGADLFLADVYLYEGNENHIAHLTSKEAGEIAYNAKVKKLVLTHVPQFPGEGINPENHLEELRLQSEKYAGGISVDLAQPHKSWDLGKL

SEQ ID NO: 10387 - DNA, 504 bp, Streptococcus agalactiae
atgcagaaatttacccaagaagaaaaagaatggtttatgacagaagctctaaaggaggcaaaatcctccttagagaaagaagaaattcctataggttgtgtcattgtaaaagatggtcatattattggaagaggacataatgctcgtgaagagtttaataaagctattttacatgctgaaatcatggctattaacaatgcaaatgagaaggtagggaattggcgcttattagatactactttatttgttactgtagaaccttgtgtaatgtgtagtggagctattggcttagctagaattccccacgttatatatggcgctaagaatacgaaatttggagcagcgggaagtctctatgatattttaagtgatagccgacttaatcatagagttgaggttgaaaccggcattttagaagatcaatgcgctaaaataatgcaggatttctttcgaaaaggacgacaacgcaagaaagaagctaaactaagtgaaaaaactaagatt

SEQ ID NO: 10388 - protein, 168 aa, Streptococcus agalactiae
MQKFTQEEKEWFMTEALKEAKSSLEKEEIPIGCVIVKDGHIIGRGHNAREEFNKAILHAEIMAINNANEKVGNWRLLDTTLFVTVEPCVMCSGAIGLARIPHVIYGAKNTKFGAAGSLYDILSDSRLNHRVEVETGILEDQCAKIMQDFFRKGRQRKKEAKLSEKTKI

SEQ ID NO: 10389 - DNA, 102 bp, Streptococcus agalactiae
gtgggtcaggggaggaatccagcagccctaagcgatgctaaatgtgtgctctttttattttcaaaagtcaaagtgtttttggaaataattatgaaagtttca

SEQ ID NO: 10390 - protein, 34 aa, Streptococcus agalactiae
MGQGRNPAALSDAKCVLFLFSKVKVFLEIIMKVS

SEQ ID NO: 10391 - DNA, 132 bp, Streptococcus agalactiae
atgtgtgctctttttattttcaaaagtcaaagtgtttttggaaataattatgaaagtttcataaaaattggtagcgtttcaaaaaatatgaaaatacagttaaaaaaccttgaaaaaaaactcacaaaagag

SEQ ID NO: 10392 - protein, 44 aa, Streptococcus agalactiae
MCALFIFKSQSVFGNNYESFIKIGSVSKNMKIQLKNLEKKLTKE

SEQ ID NO: 10393 - DNA, 459 bp, Streptococcus agalactiae
atgataataaattcattcgataatagtagaaaagcgattattaatcctgaagatattaattcaccaataaaaggttttccaaagactgttattacctgtttcgcgcgggagactttcaatcgtattttagaagaattgcctcatcgtgaaattgctagaactagtgtagcaaacttagaaattcccatttatgaattagaatttaaaggacaaaagattggctttttcaatgcttatgttggtgcttcagcttgcgtagcaatcttggaagatattatagtatttggaatggaaagtttaattgtttttggaacatgtggcgtccttgattcgtcaattgaggagacatccattattattccaagaagtgctattagggatgaagggacatcatttcattattcggaagcaagttctgaaattgcagtaaacacaaattcaatttttttactctgcgga

SEQ ID NO: 10394 - protein, 153 aa, Streptococcus agalactiae
MIINSFDNSRKAIINPEDINSPIKGFPKTVITCFARETFNRILEELPHREIARTSVANLEIPIYELEFKGQKIGFFNAYVGASACVAILEDIIVFGMESLIVFGTCGVLDSSIEETSIIIPRSAIRDEGTSFHYSEASSEIAVNTNSIFLLCG

SEQ ID NO: 10395 - DNA, 387 bp, Streptococcus agalactiae
atgcatatcaaagaagttagtaaaaagactggcattacgtcagataccatcaggtattatgagagaattaatcttattccccctattcatcggagtgaatcaggaattcgtgagttcacacaaaacgatattgatattttagaatttgtccgctattttagaggcgcaggtgtttccgttgaaagtctcattgattatattcatttggttgaaaaaggcgattccactatcccagctaggctagaaattttaaaagatgaacgcgacaatcttgaagataggcttcaaggcctccaagaagcacttaatcgtctaaatcacaaaatagacaattatcaaaataaagttgttcctagagaacaagaactttttgatccaacaacgaaa

SEQ ID NO: 10396 - protein, 129 aa, Streptococcus agalactiae
MHIKEVSKKTGITSDTIRYYERINLIPPIHRSESGIREFTQNDIDILEFVRYFRGAGVSVESLIDYIHLVEKGDSTIPARLEILKDERDNLEDRLQGLQEALNRLNHKIDNYQNKVVPREQELFDPTTK

SEQ ID NO: 10397 - DNA, 186 bp, Streptococcus agalactiae
atgagtgatattgaggtatattctgtattagtttctcgtattgaatattctgatggtacaggttcaaaggttcgtcctgctgtagtagtcaaatttaatgatgaagtaataaaaactttaagatttactactaaatatgaaaataagtctgacaatataagaagtcagtatttagaagttattgat

SEQ ID NO: 10398 - protein, 62 aa, Streptococcus agalactiae
MSDIEVYSVLVSRIEYSDGTGSKVRPAVVVKFNDEVIKTLRFTTKYENKSDNIRSQYLEVID

SEQ ID NO: 10399 - DNA, 267 bp, Streptococcus agalactiae
ttgaagaatatcttcgatatgtataaatactatttctttcaaaatcaatatcatcccaagttactctataaaattgtttacgaaaataaactattcaaagaaataaccattgatttagaaatttcaaaggaatgtttagaaatacgacttttccatctacttaaagattattccaatttgaacaataaagaaataagtacgatcgttagtaactttcaaagaaataaaaatcaaaccatgaatttagctctttatgatatcataaca

SEQ ID NO: 10400 - protein, 89 aa, Streptococcus agalactiae
MKNIFDMYKYYFFQNQYHPKLLYKIVYENKLFKEITIDLEISKECLEIRLFHLLKDYSNLNNKEISTIVSNFQRNKNQTMNLALYDIIT

SEQ ID NO: 10401 - DNA, 213 bp, Streptococcus agalactiae
atgttaacgatgcttaacaattcagctaaggagaaagccataaaagagtacttacgtgtcctaaaacctggtggacgtttactcacacatgatgtttcttatcaagatgaagacactgccaagctgatcgatcaacttagacatactatgaatgttaacgttgctcctctaaaaatagatgattggcaaaatttattcttacaaaatggtttt

SEQ ID NO: 10402 - protein, 71 aa, Streptococcus agalactiae
MLTMLNNSAKEKAIKEYLRVLKPGGRLLTHDVSYQDEDTAKLIDQLRHTMNVNVAPLKIDDWQNLFLQNGF

SEQ ID NO: 10403 - DNA, 201 bp, Streptococcus agalactiae
atggtgtcagcgctacttaagtttgattttagcgttgtaaggcataatatggctattaaagttaataatagttttttaatcattatgggaacctcgtttctcttactgctagcttatcatatcaaaaaagaaggaaaagagatactatcttctctgtttgttataagcaattttttgataactctaccttattttttgtta

SEQ ID NO: 10404 - protein, 67 aa, Streptococcus agalactiae
MVSALLKFDFSVVRHNMAIKVNNSFLIIMGTSFLLLLAYHIKKEGKEILSSLFVISNFLITLPYFLL

SEQ ID NO: 10405 - DNA, 288 bp, Streptococcus agalactiae
atggattacaagttagtgatgattattctcatcttagtcatattgatttatttgttgttgcgccttcactatttagaagagttgctaaaacattatcacttcaaaaatgatgaaggagtttgttcattatcaagaacaaaaaatccattgtatctattaatggcaatgattacttttttgccaaatcttatcaattggatagctaatggttttgaggcaatagacattgttcgcctgattcctgtggtagtctttttatggttgtattattgtggagatgacgacgaa

SEQ ID NO: 10406 - protein, 96 aa, Streptococcus agalactiae
MDYKLVMIILILVILIYLLLRLHYLEELLKHYHFKNDEGVCSLSRTKNPLYLLMAMITFLPNLINWIANGFEAIDIVRLIPVVVFLWLYYCGDDDE

SEQ ID NO: 10407 - DNA, 93 bp, Streptococcus agalactiae
atgctaaaaaaatcagaccacgaagtgaagctcctccacaatagtttagcatcagctgtagtcccagaagaaagaacaccaaaatcagctagt

SEQ ID NO: 10408 - protein, 31 aa, Streptococcus agalactiae
MLKKSDHEVKLLHNSLASAVVPEERTPKSAS

SEQ ID NO: 10409 - DNA, 90 bp, Streptococcus agalactiae
ttgaataaacagtttgctattggaagtgaccgaaaaataagcattctgaatgctaaaaaaatcagaccacgaagtgaagctcctccacaa

SEQ ID NO: 10410 - protein, 30 aa, Streptococcus agalactiae
MNKQFAIGSDRKISILNAKKIRPRSEAPPQ

SEQ ID NO: 10411 - DNA, 387 bp, Streptococcus agalactiae
atgtctaccatctattttatttctttatgcatgagttttatcttaagttattatgatataaaataccaagagtatcctatttttctatggatattattcaccatttcaacgataattctcacaccgattacaaaagtttctattgttttgtgtttatttgggattttagctgaagtggttgatattaatatcggaagtggagatttcctttatttagccacaattggcttatctttacctcttcatcaaatgctttttattattcaaataggtgcttggttaggaattatttattgtttagttatgagaaaaatgaaaaaaacgatagcttttctaccgtttttaagtatcgcttatataatcgtcaccagttactctcttttattc

SEQ ID NO: 10412 - protein, 129 aa, Streptococcus agalactiae
MSTIYFISLCMSFILSYYDIKYQEYPIFLWILFTISTIILTPITKVSIVLCLFGILAEVVDINIGSGDFLYLATIGLSLPLHQMLFIIQIGAWLGIIYCLVMRKMKKTIAFLPFLSIAYIIVTSYSLLF

SEQ ID NO: 10413 - DNA, 243 bp, Streptococcus agalactiae
atgttttacttaattgttgcccttttgattgccttgtattacttttttatggcaccaaaaacagtacgtaatactttgaacgctattggtttagtaggtttggtagccttattacttgtcttggcagttatgagttttattaaaatccttcaattgccaggtgaattgtatattgggcttataatgattcctctaggatatacagcatttaaagaaacattgaatttgtcagaaaagaagaaa

SEQ ID NO: 10414 - protein, 81 aa, Streptococcus agalactiae
MFYLIVALLIALYYFFMAPKTVRNTLNAIGLVGLVALLLVLAVMSFIKILQLPGELYIGLIMIPLGYTAFKETLNLSEKKK

SEQ ID NO: 10415 - DNA, 252 bp, Streptococcus agalactiae
atgatattagtactattaatattattaaaaacaattagggtctattcttatatcttactagcctatgccttgttatcttggtttccaggagcatacgattcatggattggtagactagtggtacagattgttgatccgattattcgcccactcagaagatttaatctacaatttttaggtctagattttacagtaatagtagcattctttttactaaatatgttgagtagatttttaatcttgctttttaca

SEQ ID NO: 10416 - protein, 84 aa, Streptococcus agalactiae
MILVLLILLKTIRVYSYILLAYALLSWFPGAYDSWIGRLVVQIVDPIIRPLRRFNLQFLGLDFTVIVAFFLLNMLSRFLILLFT

SEQ ID NO: 10417 - DNA, 102 bp, Streptococcus agalactiae
atgactactgagaaaaatcgttatttgcggattttagacgataaaatcgttaaaaagttagtaaaaatgttgcttttcatgttgctttggtcacttttgtgt

SEQ ID NO: 10418 - protein, 34 aa, Streptococcus agalactiae
MTTEKNRYLRILDDKIVKKLVKMLLFMLLWSLLC

SEQ ID NO: 10419 - DNA, 228 bp, Streptococcus agalactiae
atggaatcacatttagtgagaatcatcaatcgcctcgaattaatggcgactgatggtggtaatttaaaacgtaattttgaacgtgaaggtgttgttgtagcagaagtatcttttagtaatgaccctgaaaacggtcctgttttcacattacgtgatgtagaagcgcgtgaatcatattcatttgacagcattgaccttatcgcaatggaaatttacgatttattatac

SEQ ID NO: 10420 - protein, 76 aa, Streptococcus agalactiae
MESHLVRIINRLELMATDGGNLKRNFEREGVVVAEVSFSNDPENGPVFTLRDVEARESYSFDSIDLIAMEIYDLLY

SEQ ID NO: 10421 - DNA, 195 bp, Streptococcus agalactiae
atgtcagaaaaagctatactattaattatccttattgcttttgttattatcgctattataaagatagctctgttaaagttatatatgaatacgataaaacctaaagtagataatgaaggaaacatcataacaaagcctgtaaaggatgatttaacacccgaggaacgtgaagaacgtgaatttgataaagattgg

SEQ ID NO: 10422 - protein, 65 aa, Streptococcus agalactiae
MSEKAILLIILIAFVIIAIIKIALLKLYMNTIKPKVDNEGNIITKPVKDDLTPEEREEREFDKDW

SEQ ID NO: 10423 - DNA, 114 bp, Streptococcus agalactiae
gtgactgaaaatatgattgaatttagaaaactaaattcattttttcgtgtgatcttggtaactgccaagatcttttttattgccatgactattgttaatagtttcataaaagca

SEQ ID NO: 10424 - protein, 38 aa, Streptococcus agalactiae
MTENMIEFRKLNSFFRVILVTAKIFFIAMTIVNSFIKA

SEQ ID NO: 10425 - DNA, 180 bp, Streptococcus agalactiae
ttgggaaaaagggtaaaaacaactggcattgcacaaattgtggaagaacgtttaagacaaaataaaaaagccccacgctcaaattttgtccaaggagagcgtgaggcaaattctagtatagtaaaaacctgctttttgggaggggtttttaccatacctattttaacagaaaatgaggta

SEQ ID NO: 10426 - protein, 60 aa, Streptococcus agalactiae
MGKRVKTTGIAQIVEERLRQNKKAPRSNFVQGEREANSSIVKTCFLGGVFTIPILTENEV

SEQ ID NO: 10427 - DNA, 195 bp, Streptococcus agalactiae
ttgttttatacctcattttctgttaaaataggtatggtaaaaacccctcccaaaaagcaggtttttactatactagaatttgcctcacgctctccttggacaaaatttgagcgtggggcttttttattttgtcttaaacgttcttccacaatttgtgcaatgccagttgtttttaccctttttcccaaccaaacc

SEQ ID NO: 10428 - protein, 65 aa, Streptococcus agalactiae
MFYTSFSVKIGMVKTPPKKQVFTILEFASRSPWTKFERGAFLFCLKRSSTICAMPVVFTLFPNQT

SEQ ID NO: 10429 - DNA, 141 bp, Streptococcus agalactiae
atgagaccaaaacaatatccgtatagcggaaataaaaaagaatctattgcggtaacagtagattccaaaacgctagccgagaaactagagattactgaccaatcgaatatttcccaagcgaaacaccgattatttggtctg

SEQ ID NO: 10430 - protein, 47 aa, Streptococcus agalactiae
MRPKQYPYSGNKKESIAVTVDSKTLAEKLEITDQSNISQAKHRLFGL

SEQ ID NO: 10431 - DNA, 99 bp, Streptococcus agalactiae
ttgatttcatcttcacatcaagaattcaaaatgccgtttgtctacttgtttacagaccaaataatcggtgtttcgcttgggaaatattcgattggtcag

SEQ ID NO: 10432 - protein, 33 aa, Streptococcus agalactiae
MISSSHQEFKMPFVYLFTDQIIGVSLGKYSIGQ

SEQ ID NO: 10433 - DNA, 129 bp, Streptococcus agalactiae
atgttaattaataaaaatttagtaagagacattagacttgctatcaatgaatacgatgataattatgacgaagataacgcagaagtttgtatagaagtcattagacgattgattgaacaggaggaattc

SEQ ID NO: 10434 - protein, 43 aa, Streptococcus agalactiae
MLINKNLVRDIRLAINEYDDNYDEDNAEVCIEVIRRLIEQEEF

SEQ ID NO: 10435 - DNA, 129 bp, Streptococcus agalactiae
atgaatattgaagacattgaacgtattatttcagaatatctaatttttaggtctgacattgatggttgtgcagtaattgacattgaagattttttaaagcatattcgtttttcgtatgagcgactaaaa

SEQ ID NO: 10436 - protein, 43 aa, Streptococcus agalactiae
MNIEDIERIISEYLIFRSDIDGCAVIDIEDFLKHIRFSYERLK

SEQ ID NO: 10437 - DNA, 213 bp, Streptococcus agalactiae
atgatttatagagacaaaaacacaggagcagtagtcgttactgactgtgcgctgttaggcgactgggagattgttcctaacacagtagataagacaccgacaagtgatgaaaaatcttggaccgttcaaactctgaaagaacatttgacagggctaggaattgagtataactcgtctgctacaaaatctgagttattagaattactccctaaa

SEQ ID NO: 10438 - protein, 71 aa, Streptococcus agalactiae
MIYRDKNTGAVVVTDCALLGDWEIVPNTVDKTPTSDEKSWTVQTLKEHLTGLGIEYNSSATKSELLELLPK

SEQ ID NO: 10439 - DNA, 333 bp, Streptococcus agalactiae
ttgattgaagtaattatcaaaaaatatttagacgagcatttagatgtgccgtctttttttgaacatcaaaaagatgaacctgcacgattcatcattttagaaaagactagcggggctaagcaaaatcatttgctaagttccacgtttgcttttcaaagttatgccgaatcgttgtatgaggcggctttacttaatgacaaagtaaagcaagtaattgagcagcttgatgtcttgccacaagtttctggtgtacatcttaacgctgactacaattttacagatacagcaactaagcgctatcgctatcaagctgtatttgacattaatcattat

SEQ ID NO: 10440 - protein, 111 aa, Streptococcus agalactiae
MIEVIIKKYLDEHLDVPSFFEHQKDEPARFIILEKTSGAKQNHLLSSTFAFQSYAESLYEAALLNDKVKQVIEQLDVLPQVSGVHLNADYNFTDTATKRYRYQAVFDINHY

SEQ ID NO: 10441 - DNA, 234 bp, Streptococcus agalactiae
ttgacaacatctactgcctcttcaacagcatctttagcatcatctgctagttctttacctttagcaattgttttttcgacaaaaccttttgcctctaactctttatcgccagttagcttaccagctccttcttttaggctacctgatgcttgttcaacttttgattttagtttttcttgtgacataatgtgtctccttattatttttattaattataacatctatatctttctt

SEQ ID NO: 10442 - protein, 78 aa, Streptococcus agalactiae
MTTSTASSTASLASSASSLPLAIVFSTKPFASNSLSPVSLPAPSFRLPDACSTFDFSFSCDIMCLLIIFINYNIYIFL

SEQ ID NO: 10443 - DNA, 198 bp, Streptococcus agalactiae
gtgcctattcaggccttatgccaactcttgaaggggtctcgttcaggctattacaagtggctcaatcgtcaaaaaacagattttgagacaaaaaatacaaagctaatggctaaaatcaaggaacttcatagactctacaatggtatcttaggttatcgccgtatgacaacatttattaatcgtcaacttgggacaact

SEQ ID NO: 10444 - protein, 66 aa, Streptococcus agalactiae
MPIQALCQLLKGSRSGYYKWLNRQKTDFETKNTKLMAKIKELHRLYNGILGYRRMTTFINRQLGTT

SEQ ID NO: 10445 - DNA, 207 bp, Streptococcus agalactiae
atgtcccggattggcaaatgtattgataatgcaccaactgaaagtttctttgggtttttcaagactgagtcttaccaccttaagaaatacaactcttatgatgagttggtcaatgatgtggcacgttatatcgaattctacaacacacaacgttatcaatcaaaattaaacaacctgactcctctagaattcaggaatcaggttgca

SEQ ID NO: 10446 - protein, 69 aa, Streptococcus agalactiae
MSRIGKCIDNAPTESFFGFFKTESYHLKKYNSYDELVNDVARYIEFYNTQRYQSKLNNLTPLEFRNQVA

SEQ ID NO: 10447 - DNA, 114 bp, Streptococcus agalactiae
ttggtaaccatttttatgaaattttttaaagttaaaaatataatttataatactatcttcttccattttctgattttagttctgaaagttccaaaaggtgcaaccgtatttaca

SEQ ID NO: 10448 - protein, 38 aa, Streptococcus agalactiae
MVTIFMKFFKVKNIIYNTIFFHFLILVLKVPKGATVFT

SEQ ID NO: 10449 - DNA, 234 bp, Streptococcus agalactiae
ttgttttttccgaatattgacaacataattaaaaactatatcaaagagatgattacacattccgatataccagacttacaaaaacaactggaaacagcatatcaagttccatattctttcgctcttggtatttatatctcaacaattgaaagtattattttaaattggatagatcatgactttactgaagagcctgaagaaatagcaagatatattacatctgtcgtgagaatt

SEQ ID NO: 10450 - protein, 78 aa, Streptococcus agalactiae
MFFPNIDNIIKNYIKEMITHSDIPDLQKQLETAYQVPYSFALGIYISTIESIILNWIDHDFTEEPEEIARYITSVVRI

SEQ ID NO: 10451 - DNA, 390 bp, Streptococcus agalactiae
gtgaactattatttgaatttgtattgtataatcacattcgataagatttataactttaagattttatataaaggtgatagtatattggtaagttcagataacactaatttaaaatttttaaaagctttctcagaattgttaaagatgaggagctttgagcaaattaaagttagcgatttagcaaaaaaagctcgacttagtagaagatctttctataatcattacaattcaaaagaagacttccttagggagtctattttaataatctttgatgatatcacaaaaattttaaataatgatttattatatgaagaagtggtcttaaaggagatgcttagctatatgtatataaataaagaaattattaaatcctttgttttttccgaatat

SEQ ID NO: 10452 - protein, 130 aa, Streptococcus agalactiae
MNYYLNLYCIITFDKIYNFKILYKGDSILVSSDNTNLKFLKAFSELLKMRSFEQIKVSDLAKKARLSRRSFYNHYNSKEDFLRESILIIFDDITKILNNDLLYEEVVLKEMLSYMYINKEIIKSFVFSEY

SEQ ID NO: 10453 - DNA, 327 bp, Streptococcus agalactiae
atgcttaggaagtataagcaaagaaattataatgtcgcacatacgaaacagcgtttttcgattaagaaattcaaatttggtgtagcatcggtattaattggattgacatttctaggaatgagtagtcattctgttttggcggatgagtcaagcattatgagtactgaggtaccacaaacagctggtgtaaaaccggaagttactgttacacagcctacttcagatgtaacaagtcttgcgacagatacgtcaacttcagcagtgttatcaacagatgcatctcattctaatcctacagaatcagcggagcatgctgtaggattagaa

SEQ ID NO: 10454 - protein, 109 aa, Streptococcus agalactiae
MLRKYKQRNYNVAHTKQRFSIKKFKFGVASVLIGLTFLGMSSHSVLADESSIMSTEVPQTAGVKPEVTVTQPTSDVTSLATDTSTSAVLSTDASHSNPTESAEHAVGLE

SEQ ID NO: 10455 - DNA, 318 bp, Streptococcus agalactiae
gtgttacaatctgttttaaaagacacaaaaacgaaaggacaacctatgtcaacatttaaacgctatgatgaagaattcaaacaatctcttgttaacctttatcaaactggaaaaactcagtctgaactctgtaaagactatagggtatccacttctgcgcttgcaaaatggatcaaacagtactctcaattcaaactcgaagataattctgtacttactgccaagcaaatacaagagttacaaaaacgtaatgcgcagcttgaagaggagaaccttatcctaaaaaaagcaagtgccatattcatgcaaaacttaaag

SEQ ID NO: 10456 - protein, 106 aa, Streptococcus agalactiae
MLQSVLKDTKTKGQPMSTFKRYDEEFKQSLVNLYQTGKTQSELCKDYRVSTSALAKWIKQYSQFKLEDNSVLTAKQIQELQKRNAQLEEENLILKKASAIFMQNLK

SEQ ID NO: 10457 - DNA, 186 bp, Streptococcus agalactiae
atgagcggattgctaagagcaattgtcaaaatttctcagtctatgctagaagagttcttcttaatcccaatatgtcatttgtcacgattaacacggattggaaataacatcaatcaaattgcgcgtgctatcaaccaaagccatctaatttctcaggctcagtatcactttcatcgagaagcacgt

SEQ ID NO: 10458 - protein, 62 aa, Streptococcus agalactiae
MSGLLRAIVKISQSMLEEFFLIPICHLSRLTRIGNNINQIARAINQSHLISQAQYHFHREAR

SEQ ID NO: 10459 - DNA, 144 bp, Streptococcus agalactiae
atggggaatggtcattttgtgaccatcatcgactatggcacaggtaatccctatacctcaacaacgcctcttattactgggaaaattggtgaggattttgcttattacttaaccgaatcagagcaacccccctgctgttgggct

SEQ ID NO: 10460 - protein, 48 aa, Streptococcus agalactiae
MGNGHFVTIIDYGTGNPYTSTTPLITGKIGEDFAYYLTESEQPPCCWA

SEQ ID NO: 10461 - DNA, 96 bp, Streptococcus agalactiae
ttgttttcatcattttattttgtagtctttacaaacctaaagaaaaattctagaaatgataatgaaggcggtctatcaaatggttacattcgattt

SEQ ID NO: 10462 - protein, 32 aa, Streptococcus agalactiae
MFSSFYFVVFTNLKKNSRNDNEGGLSNGYIRF

SEQ ID NO: 10463 - DNA, 93 bp, Streptococcus agalactiae
ttgaaaattcatatcgtcgacgaaaaacaattagaagttctagaactattagctatatttgaatttcaaaatggaaagcacttaggatactct

SEQ ID NO: 10464 - protein, 31 aa, Streptococcus agalactiae
MKIHIVDEKQLEVLELLAIFEFQNGKHLGYS

SEQ ID NO: 10465 - DNA, 102 bp, Streptococcus agalactiae
atgatatttgaagagtccaaagatctaatagatagtccagttagagaagcgttgattataagtgataaggattttcaaaaattaaaacaagagctattattt

SEQ ID NO: 10466 - protein, 34 aa, Streptococcus agalactiae
MIFEESKDLIDSPVREALIISDKDFQKLKQELLF

SEQ ID NO: 10467 - DNA, 108 bp, Streptococcus agalactiae
gtgtcactccaatcttttaaactgtttttaggacattttttaaagacagagataaggttatcaatgtccttgaatcgccttattcaaacaccaaacttgagcaaccaa

SEQ ID NO: 10468 - protein, 36 aa, Streptococcus agalactiae
MSLQSFKLFLGHFLKTEIRLSMSLNRLIQTPNLSNQ

SEQ ID NO: 10469 - DNA, 303 bp, Streptococcus agalactiae
atgggacgttctaatattttgagtaggtgtgaacaatgttctgataatcaatgtggcttgtataaaacgcggcttaaagacaagttactattagtagtccaactggttggaaatattaggtattctgagtttcttacggaaggtggtgtatatcataagggagaaaccttgttggaagttataaccttaggaatttcttatgaatataaaagttatggggatatcaaagtaatcaagaagtactgtgctgatggcagtgtcgttgattataacatgccaatactattaatggaaaggattgaa

SEQ ID NO: 10470 - protein, 101 aa, Streptococcus agalactiae
MGRSNILSRCEQCSDNQCGLYKTRLKDKLLLVVQLVGNIRYSEFLTEGGVYHKGETLLEVITLGISYEYKSYGDIKVIKKYCADGSVVDYNMPILLMERIE

SEQ ID NO: 10471 - DNA, 474 bp, Streptococcus agalactiae
atgaccaagctaagtagtgaagaaattataaaaatgttacctcatcgctatccgtttctaatggtggatagagtgcagagttataaaaaaggtatcattgaatgtcgtaagaatattactatcaacgaaccttactttcaaggacattttccacaacgtcctatagttccgggtgttttgatgattgagatggcagctcaatctgcagctttactttatattttagatgcacttgatggtagcctcccctctcttgatgaattaacagcagagaaaatagcagaaaaagtaggttatttagccagtgtgaagaatttcaaattcaagaaaattgttactccaggagaccagctaaacattacatgtaaatctcaatcaaaattggggcatcttttagaaattcaagtcgttattagagatgagaataaaaaagaggttgcctcaggaaggatgttggtatcagaaaatggaaat

SEQ ID NO: 10472 - protein, 158 aa, Streptococcus agalactiae
MTKLSSEEIIKMLPHRYPFLMVDRVQSYKKGIIECRKNITINEPYFQGHFPQRPIVPGVLMIEMAAQSAALLYILDALDGSLPSLDELTAEKIAEKVGYLASVKNFKFKKIVTPGDQLNITCKSQSKLGHLLEIQVVIRDENKKEVASGRMLVSENGN

SEQ ID NO: 10473 - DNA, 339 bp, Streptococcus agalactiae
atgagtgaattcctttcagccaaacctattggtcataatgattcatctaatactattttaagaattatagagaatacgaaatatattcatcactatgatggaaaagttgttgtcgaaattcctcctcaaaaagagcctatcaaagtcttttttatggattcacgtcttcattatttagaattttcagacatatgtcggtatgtaactgttgttttgaaaaatagtaccgttgataatataaccaatttagggccagataatcatattgtttatgacaatggtgatgatatggttgatccgttgccgagtattcagcatggattatttcttaatgatgat

SEQ ID NO: 10474 - protein, 113 aa, Streptococcus agalactiae
MSEFLSAKPIGHNDSSNTILRIIENTKYIHHYDGKVVVEIPPQKEPIKVFFMDSRLHYLEFSDICRYVTVVLKNSTVDNITNLGPDNHIVYDNGDDMVDPLPSIQHGLFLNDD

SEQ ID NO: 10475 - DNA, 135 bp, Streptococcus agalactiae
gtgtttgatgcagcacacgccgtacaaagtagtaggcttaaagcaacagttgatagctttgttatattcttcatgcattctccttattgtctggaaaacatagctttaccaaagtgtcaaacgtttttctggttt

SEQ ID NO: 10476 - protein, 45 aa, Streptococcus agalactiae
MFDAAHAVQSSRLKATVDSFVIFFMHSPYCLENIALPKCQTFFWF

SEQ ID NO: 10477 - DNA, 192 bp, Streptococcus agalactiae
ttgctaacaagttatgcaaaaagtatagatgtcttgaatcaattaattacttctctacaaggcggcatgttagtagtatctattatcctagtgatgatggctctgctattctggattggtggtagaacccatgagacaggtattttattagctattggtaagtctaaagcaattatcattgtcagtacgcag

SEQ ID NO: 10478 - protein, 64 aa, Streptococcus agalactiae
MLTSYAKSIDVLNQLITSLQGGMLVVSIILVMMALLFWIGGRTHETGILLAIGKSKAIIIVSTQ

SEQ ID NO: 10479 - DNA, 96 bp, Streptococcus agalactiae
atgatatcggctccagaaatgattgctacggtagaggtattcttgattagattaacaacttggttggtcattggtggtaaaattgttctgacagct

SEQ ID NO: 10480 - protein, 32 aa, Streptococcus agalactiae
MISAPEMIATVEVFLIRLTTWLVIGGKIVLTA

SEQ ID NO: 10481 - DNA, 456 bp, Streptococcus agalactiae
ttggacttagtcttatcaagccagacggacttgactaattatgttaagaaggtgtctatagaagattttggatgtcagtttttacatactgcacattggaataatcgcttaagaacaactggaggacgcttctttccaaacgatagacaccttgactttaatcccaaaatttatcgtgagtttggtattgatatttttcgtaagattgtaagacatgagctttgccattatcatctctatatacaaggtaaaggatatcaacatagggataaagcttttaaagagttactagaaaaagtcgatggcttacgatatacccctagagttacggctgttaaagtgaattatcatcattactcttgccaatcttgcggtcaagtataccgacgtaggagacgtgttaatttacgcaagtttgcttgtggttattgtcatggtcgcttgatagagagtttt

SEQ ID NO: 10482 - protein, 152 aa, Streptococcus agalactiae
MDLVLSSQTDLTNYVKKVSIEDFGCQFLHTAHWNNRLRTTGGRFFPNDRHLDFNPKIYREFGIDIFRKIVRHELCHYHLYIQGKGYQHRDKAFKELLEKVDGLRYTPRVTAVKVNYHHYSCQSCGQVYRRRRRVNLRKFACGYCHGRLIESF

SEQ ID NO: 10483 - DNA, 168 bp, Streptococcus agalactiae
atgaatgaagagactgcagatgtaactgctagacttgccagcatcgctagtaagaaactccagacaggtgttaaacttagtgctagtaataagaaagagattagcacagtggttatactgaagagagcgatacgagcaaaaaagactagctcacgcaacttagcactg

SEQ ID NO: 10484 - protein, 56 aa, Streptococcus agalactiae
MNEETADVTARLASIASKKLQTGVKLSASNKKEISTVVILKRAIRAKKTSSRNLAL

SEQ ID NO: 10485 - DNA, 273 bp, Streptococcus agalactiae
atgtcatcaccacttaagcaagagcaaactcacgaaagcaaaacagagcaagctcaaccaaaatttcaagtatttcaagaatttgatcacagtgctaagttgcgtgagctagtcttttttgctcgtatcgctctcttcagtataaccactgtgctaatctctttcttattactagcactaagtttaacacctgtctggagtttcttactagcgatgctggcaagtctagcagttacatctgcagtctcttcattcatttggtcactcagacaa

SEQ ID NO: 10486 - protein, 91 aa, Streptococcus agalactiae
MSSPLKQEQTHESKTEQAQPKFQVFQEFDHSAKLRELVFFARIALFSITTVLISFLLLALSLTPVWSFLLAMLASLAVTSAVSSFIWSLRQ

SEQ ID NO: 10487 - DNA, 93 bp, Streptococcus agalactiae
atggactgggcaactgtttccaaggccacttatttttggaaagcccagcctttttcttttaatagtcatgattataattttgggattacttta

SEQ ID NO: 10488 - protein, 31 aa, Streptococcus agalactiae
MDWATVSKATYFWKAQPFSFNSHDYNFGITL

SEQ ID NO: 10489 - DNA, 441 bp, Streptococcus agalactiae
atgataatgagtaatcgaagtattttagacgagcgattatgttttacggttagtgaaacacatcgacttttcaataaattttaccaaaaagctttggatgaatttcaattgacttatctccaatacgttatcttgttagtcctttgggaagaggatcatcggcatatgaaggaacttagttatgcactatctcttaattcgaataccctaactccagttttaaagcgtatggaaaatcgtgggtggattgtacgagaaaaaccaagagatgataaaaggcaactcattattcatctaagtaacaaaggtattgagtcacaagatgccgttgtcaatgcggtgcaatcgtgcgggtattttttctcagaaattagtcctgaatcttatcaaaaaactgtttctgccctttcttcacttaaccaagttataaaatcacattta

SEQ ID NO: 10490 - protein, 147 aa, Streptococcus agalactiae
MIMSNRSILDERLCFTVSETHRLFNKFYQKALDEFQLTYLQYVILLVLWEEDHRHMKELSYALSLNSNTLTPVLKRMENRGWIVREKPRDDKRQLIIHLSNKGIESQDAVVNAVQSCGYFFSEISPESYQKTVSALSSLNQVIKSHL

SEQ ID NO: 10491 - DNA, 114 bp, Streptococcus agalactiae
atgaaagttttgaattcaatggttttctcctttaaaataatcacttataagtatatgaagaatactaagcaaggtcaagtgagtcgtttcactaatctaaatacctttttaaga

SEQ ID NO: 10492 - protein, 38 aa, Streptococcus agalactiae
MKVLNSMVFSFKIITYKYMKNTKQGQVSRFTNLNTFLR

SEQ ID NO: 10493 - DNA, 117 bp, Streptococcus agalactiae
gtggcaactgacataagtgtcaaaaagcctgctgcaagttttgatcttgttttcatgatttataactcctttttgtcattaactccattattatatcataatttcttaaaaatgcct

SEQ ID NO: 10494 - protein, 39 aa, Streptococcus agalactiae
MATDISVKKPAASFDLVFMIYNSFLSLTPLLYHNFLKMP

SEQ ID NO: 10495 - DNA, 243 bp, Streptococcus agalactiae
ttgaacaatcaaattaatcattgtttcaaaagcataatggttttaggagttactcaaatgaaaaaggaatttattattacaggtcggatggttgcaagagttatggaaaccctagtttgcttatgtatggtaagtaatcttgttcttgatatgcttgatataatagaaataaatgaaattgtattttgtgtgttggtagcatcaattgcagggcttgagttttgtttgcaaaaagaaagggag

SEQ ID NO: 10496 - protein, 81 aa, Streptococcus agalactiae
MNNQINHCFKSIMVLGVTQMKKEFIITGRMVARVMETLVCLCMVSNLVLDMLDIIEINEIVFCVLVASIAGLEFCLQKERE

SEQ ID NO: 10497 - DNA, 213 bp, Streptococcus agalactiae
atgggattaattttaaaaaatagactcaaagaattgcgtgcacgagatggtatcaatcaaacagaactcgctaaattaacaggagtctcaagacaaacaattagcctaattgaacgcggagaatatacgccatctgttattattgctatgaagatttctcaagtatttaaagaatccctagagaatgtttttagtttagtgtcaatggaggaa

SEQ ID NO: 10498 - protein, 71 aa, Streptococcus agalactiae
MGLILKNRLKELRARDGINQTELAKLTGVSRQTISLIERGEYTPSVIIAMKISQVFKESLENVFSLVSMEE

SEQ ID NO: 10499 - DNA, 126 bp, Streptococcus agalactiae
ttggggtgcgtaacagctgagattatacccattgaacttgatgcagttagtactgtcgaagggaaatgtgtgccattacaagttttttgtggtggaaaagggcgtagtgtcttcttagtagacagc

SEQ ID NO: 10500 - protein, 42 aa, Streptococcus agalactiae
MGCVTAEIIPIELDAVSTVEGKCVPLQVFCGGKGRSVFLVDS

SEQ ID NO: 10501 - DNA, 123 bp, Streptococcus agalactiae
atgcttcgtaaaggtttctttaaaaacttgggcgaaggtcaatctgatatcatttgtgatgggactctctttatttctagggacgtatttttggggaaaattaccccatcaattcgtcttagc

SEQ ID NO: 10502 - protein, 41 aa, Streptococcus agalactiae
MLRKGFFKNLGEGQSDIICDGTLFISRDVFLGKITPSIRLS

SEQ ID NO: 10503 - DNA, 450 bp, Streptococcus agalactiae
atgaagattgataaatatactgcgattttaggaaatactgttagttacccagatatgcacagtttgacggataatcgtccgcttgcttctctaccttttgatggtaagtatcgtttaattgattttcaattatcctctttagctaatgcaggcgttagaagtatttatggtatttttcgtgggaataatgttcgctctgtttttgaccatattagaagtggtcgtgagtggggcttaggtacactgttgagtcactattctttaggattctatgatacagacgatgatactcgtacagtcaatggggattattacgatcaaattttaacttacttgaggcgttcgggtagcgaccagacgatatatatgagttgtgatatgctttgtaatattgacttaagtcaagtaatccacttgcataatgcaaatggtgcgcaagccaccgtggtt

SEQ ID NO: 10504 - protein, 150 aa, Streptococcus agalactiae
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDTRTVNGDYYDQILTYLRRSGSDQTIYMSCDMLCNIDLSQVIHLHNANGAQATVV

SEQ ID NO: 10505 - DNA, 228 bp, Streptococcus agalactiae
atgatattaaatatagtaactatagttagtaattttatttttattgcccttttttatcaactttttgtagatttatttgactggtctaaaatgattaaaatgtcccctcaaaacatctcaaaattaaaagtttttattttgttgataagtatagttggtggctatgtggttagtcattttttattggaagtgattcagttgtgtcaatcaatcttttgggctctccaa

SEQ ID NO: 10506 - protein, 76 aa, Streptococcus agalactiae
MILNIVTIVSNFIFIALFYQLFVDLFDWSKMIKMSPQNISKLKVFILLISIVGGYVVSHFLLEVIQLCQSIFWALQ

SEQ ID NO: 10507 - DNA, 201 bp, Streptococcus agalactiae; identical to SEQ ID NO: 9015

SEQ ID NO: 10508 - protein, 67 aa, Streptococcus agalactiae
MRRNMASSGWKYVLKQIGLIVLVILLALLFLAVGLMLGYSVFGDGEHAYSILSLDKWQNIIGKFLGK

SEQ ID NO: 10509 - DNA, 168 bp, Streptococcus agalactiae
atgaaaggctataattccaaccttatggttaaagggctaggttgttctacgctttacttaattattagtttgacagcgttggttcttttagtgattgctggtgttttctttgtcattaatacttgcaagcttacaaggaaagcagtggagaacctatccataatcaac

SEQ ID NO: 10510 - protein, 56 aa, Streptococcus agalactiae
MKGYNSNLMVKGLGCSTLYLIISLTALVLLVIAGVFFVINTCKLTRKAVENLSIIN

SEQ ID NO: 10511 - DNA, 117 bp, Streptococcus agalactiae
gtgttgaataagttatggaatagtggcacgtatactaagactaaaaatgctaaaatctccattattataccaaaattaattaatttattaccaaaaatagatagtgctttaatagat

SEQ ID NO: 10512 - protein, 39 aa, Streptococcus agalactiae
MLNKLWNSGTYTKTKNAKISIIIPKLINLLPKIDSALID

SEQ ID NO: 10513 - DNA, 228 bp, Streptococcus agalactiae
atgaaaacacaatatcctatgattccctttcctctcattgtaaaggcaacagatggcgataccgaagcgattaaccagattctacatcattacagagggtacataacgaagcgttccctacgacttatgaaagatgaatatggcaatcaaagtatggtcgttgatgaagtcttacgtggaagaatggaaaccagactgattacaaagattttgtcatttgaaattaag

SEQ ID NO: 10514 - protein, 76 aa, Streptococcus agalactiae
MKTQYPMIPFPLIVKATDGDTEAINQILHHYRGYITKRSLRLMKDEYGNQSMVVDEVLRGRMETRLITKILSFEIK

SEQ ID NO: 10515 - DNA, 429 bp, Streptococcus agalactiae
gtgagaaacatgaaaccatcttcttttcagaccacaatagaaaatcagtttgactatatctgtaaacgtgctatggaagacgagcgaaagaattatatgctttatctttcaaggattgcaaagcgtgaggtgtccttttcggatgttggcgattatcttgttagccagtttgcgacaacagataactattcaactgactttcagatttttacactcaatgggttatcagtaggcgttgaaaatgatttgttgagtgaagcattacgtgagttgccagacaagaaacgtgaaattctactgctgttttactttatggacatgagcgattcagaaattgcagacctgttgaaattgaaccgttctactgtctatcggcatagaaccagtggactagccttaattaaaaagtttatggaggaatttgaagaa

SEQ ID NO: 10516 - protein, 143 aa, Streptococcus agalactiae
MRNMKPSSFQTTIENQFDYICKRAMEDERKNYMLYLSRIAKREVSFSDVGDYLVSQFATTDNYSTDFQIFTLNGLSVGVENDLLSEALRELPDKKREILLLFYFMDMSDSEIADLLKLNRSTVYRHRTSGLALIKKFMEEFEE

SEQ ID NO: 10517 - DNA, 141 bp, Streptococcus agalactiae
atgtttttgtttgtcaataaaaaaattggtatagtctttttgattttctgtgataacgagataaacgctatcaaaaattctatctatcttaaaaaaatatatttcttagccattttattacataaaaagaatggtatcaaa

SEQ ID NO: 10518 - protein, 47 aa, Streptococcus agalactiae
MFLFVNKKIGIVFLIFCDNEINAIKNSIYLKKIYFLAILLHKKNGIK

SEQ ID NO: 10519 - DNA, 123 bp, Streptococcus agalactiae
gtggaatctgagtgtttagctcagatttttaaaaaaattattattttacataacttaatttatgtatttatttttatgggagaattaataaaaaagtgctataatataggtgtattcatagtg

SEQ ID NO: 10520 - protein, 41 aa, Streptococcus agalactiae
MESECLAQIFKKIIILHNLIYVFIFMGELIKKCYNIGVFIV

SEQ ID NO: 10521 - DNA, 93 bp, Streptococcus agalactiae
atgaaaacaaataagacagctaatattggcaaaattgaacgttttctcatgtactatcctctctcttttgctctgttatggacaaatctatta

SEQ ID NO: 10522 - protein, 31 aa, Streptococcus agalactiae
MKTNKTANIGKIERFLMYYPLSFALLWTNLL

SEQ ID NO: 10523 - DNA, 117 bp, Streptococcus agalactiae
ttgattatctggcaggatttttccagagagctcaatttagaacaagtatattatttcaatgaggaagatattgatgaagtaatttttggaggtaccatgacgaagagcaagaaagag

SEQ ID NO: 10524 - protein, 39 aa, Streptococcus agalactiae
MIIWQDFSRELNLEQVYYFNEEDIDEVIFGGTMTKSKKE

SEQ ID NO: 10525 - DNA, 144 bp, Streptococcus agalactiae
atgcatacagaaaatatgaattttataaaacctaaaggatcaccaaaattacttgcatataaccctatgcaagatataaatagtccaatccatggaaaaattttaatatatgaatattctatttcaaactcaattaacggtcca

SEQ ID NO: 10526 - protein, 48 aa, Streptococcus agalactiae
MHTENMNFIKPKGSPKLLAYNPMQDINSPIHGKILIYEYSISNSINGP

SEQ ID NO: 10527 - DNA, 108 bp, Streptococcus agalactiae
gtgattccactggctcctgattgtattgcagttgcacaggtggatgcgacggaggcatcactttgtatttttgccatttggtctcctttcttagtctatggtgagttt

SEQ ID NO: 10528 - protein, 36 aa, Streptococcus agalactiae
MIPLAPDCIAVAQVDATEASLCIFAIWSPFLVYGEF

SEQ ID NO: 10529 - DNA, 165 bp, Streptococcus agalactiae
atgttagttatttgttattatcaatcactccgctacgaatttaatattgaagaggagaaatcctttctaatatcatcaaacggcaagtcgccaataccagtatcagatttagaaaatgacatcacgctaaaaaatatacaaggtcaattggtatatattattgac

SEQ ID NO: 10530 - protein, 55 aa, Streptococcus agalactiae
MLVICYYQSLRYEFNIEEEKSFLISSNGKSPIPVSDLENDITLKNIQGQLVYIID

SEQ ID NO: 10531 - DNA, 240 bp, Streptococcus agalactiae
atgaatacacatattaacattactctagatatgggggaaacctcaaaagatttacgtatccctttgaaaattagcgttaagcaattagtaatggaattagatagtatttttagccgtactgaaaggcgtaccaaatatcaactaagagttataaataaaggtattttattgggagagaacgatatattagctcaccatccagtaacaactggtgatcgtataaggatagaggagttttat

SEQ ID NO: 10532 - protein, 80 aa, Streptococcus agalactiae
MNTHINITLDMGETSKDLRIPLKISVKQLVMELDSIFSRTERRTKYQLRVINKGILLGENDILAHHPVTTGDRIRIEEFY

SEQ ID NO: 10533 - DNA, 321 bp, Streptococcus agalactiae
atgttaaaaacacgaacacatattaatgaattagaaacaaaaatcgcccttgatttagtacacagatatctaggtattcaacaacttgttttttcaaagtggaggcattctttagaaactggttcatggtcttctattataacaataaatggcgttaatattatcaattacattgttgatgatattagtgacagtaatagtatttcaggtattatttgtcatcctaaaagttttcatctcagacctagagaaaaaaaggaacctattcagtctattgatgagttagatatcacctggtctttgaatagagaggaaaatgaa

SEQ ID NO: 10534 - protein, 107 aa, Streptococcus agalactiae
MLKTRTHINELETKIALDLVHRYLGIQQLVFSKWRHSLETGSWSSIITINGVNIINYIVDDISDSNSISGIICHPKSFHLRPREKKEPIQSIDELDITWSLNREENE

SEQ ID NO: 10535 - DNA, 336 bp, Streptococcus agalactiae
atgcaaatcatcaaacgtgatggacagattgttgaatttgatcctgaaaaaatctaccaagctatcttgaaagctgctcaaacagtttatgtgcttgatgagtcacttcgtcaagaccttgctcaagtgactaaaaaagtaatcttagatttagaggatgctcaggttgaacgaccaacgatcaatatgattcagtctttggttgaaaatcgtttattggatgcaggatacattcatactgctgaacactatatttcataccgtttgcaacgtgatttagagcgaaatggctatgatgatcaaatcactgttcatttacactttgaaaaaattaag

SEQ ID NO: 10536 - protein, 112 aa, Streptococcus agalactiae
MQIIKRDGQIVEFDPEKIYQAILKAAQTVYVLDESLRQDLAQVTKKVILDLEDAQVERPTINMIQSLVENRLLDAGYIHTAEHYISYRLQRDLERNGYDDQITVHLHFEKIK

SEQ ID NO: 10537 - DNA, 141 bp, Streptococcus agalactiae
atgttaactaataattctagaacaatttcagtgataaataaattacctaaaacaggtgatgatcaaaatgtcatttttaaacttgtaggttttggtttaattttgttaacaagtcgctgcggtttgagacgcaatgaaaat

SEQ ID NO: 10538 - protein, 47 aa, Streptococcus agalactiae
MLTNNSRTISVINKLPKTGDDQNVIFKLVGFGLILLTSRCGLRRNEN

SEQ ID NO: 10539 - DNA, 90 bp, Streptococcus agalactiae
atgcaaaaaagaaagaaccaaactggttctttcttttttgcttttcagctacttaccacaatttgtaagaaattacaagtagtagtaagc

SEQ ID NO: 10540 - protein, 30 aa, Streptococcus agalactiae
MQKRKNQTGSFFFAFQLLTTICKKLQVVVS

SEQ ID NO: 10541 - DNA, 195 bp, Streptococcus agalactiae
atgaaaaaaaggcttcaactattattactgatatttatttctgcagtttcatggtttatcagtaaccaactagcaactaagaatacggtattatctgttttaataggtttagttgcagttattgggataacgtggttaattgtaagtctgctctattatttgatcgtgaagttaattgcagttatatttcatgat

SEQ ID NO: 10542 - protein, 65 aa, Streptococcus agalactiae
MKKRLQLLLLIFISAVSWFISNQLATKNTVLSVLIGLVAVIGITWLIVSLLYYLIVKLIAVIFHD

SEQ ID NO: 10543 - DNA, 345 bp, Streptococcus agalactiae
atggcatttgaaaaagaaataaatcttccagactgcaattacatttacactatcagcccgaacattaaaaaatataccttacgcgatactacattcactcaaaatcgcttaggtaattatgaattagagcgtctcctagaaacagtgcctaattctggcgatggctttcctctaaagattacaatcaataaagaactttctggttttaagctcttaattactgataaatctggccttagaatagtaaatatctttaaatctaccgatcataaaattcttcaagacaaattttatttcttaatggacagcctcgttgagcgtgatatctttacgaaaaccacaaaa

SEQ ID NO: 10544 - protein, 115 aa, Streptococcus agalactiae
MAFEKEINLPDCNYIYTISPNIKKYTLRDTTFTQNRLGNYELERLLETVPNSGDGFPLKITINKELSGFKLLITDKSGLRIVNIFKSTDHKILQDKFYFLMDSLVERDIFTKTTK

SEQ ID NO: 10545 - DNA, 339 bp, Streptococcus agalactiae
atgtctaggaaaacatttaaacgtatactatcgattggagtttgcacgctcgtactatcgatgagtctttattacactgaaaaagcccacgctattgctggtcctagtgaccgccaatacgtagaaaacccaaatcctcacattattgtaaatgttacaggtactgatcaaaacggaaatagcattttaccgcattatatcgaagtcaatgtaaagatgggacaaactttaagtaaaaaagaaattctagattatattgctcgaaatttaaactctagtgtggaggagaaagtaaaaacgttcaatacagcaacatcgagtttaaggaaagtgcttatc

SEQ ID NO: 10546 - protein, 113 aa, Streptococcus agalactiae
MSRKTFKRILSIGVCTLVLSMSLYYTEKAHAIAGPSDRQYVENPNPHIIVNVTGTDQNGNSILPHYIEVNVKMGQTLSKKEILDYIARNLNSSVEEKVKTFNTATSSLRKVLI

SEQ ID NO: 10547 - DNA, 237 bp, Streptococcus agalactiae
atgacactcttcttagattctttactaaaggagctaataatcgtgaatcgtcttagagaatacagaattaaagctagcatatctcaattagctttagcaaaatcagttggtgtcgccagacaaacaataaaccttattgaaaataataaatacaatccttcgctagatctttgtataagactagcggaatgcctacaaacagacctcaatactcttttttgggatagtagacatcta

SEQ ID NO: 10548 - protein, 79 aa, Streptococcus agalactiae
MTLFLDSLLKELIIVNRLREYRIKASISQLALAKSVGVARQTINLIENNKYNPSLDLCIRLAECLQTDLNTLFWDSRHL

SEQ ID NO: 10549 - DNA, 390 bp, Streptococcus agalactiae
atgaaattatacgttcaattaatggttattttaaccttttcattcgctggtgaggttctatctactatattcaacttacctgtaccaggcagtattattggattaatattactattcctagcgttaaaatacaaaatcatcaggctcaggcatattgatgccgtggggaattttctattagcaaatatgaccattttatttttaccaccagcagttggactgatggagcactttcaagacataaagccctatctttttgggatagctatcattatcttaggagcgctatttctcaatattctaactattggactggtatcccaatggatcaaaaagagatatgaaggagattatccagaaattggaggtaaaaatggcaactttaacgaa

SEQ ID NO: 10550 - protein, 130 aa, Streptococcus agalactiae
MKLYVQLMVILTFSFAGEVLSTIFNLPVPGSIIGLILLFLALKYKIIRLRHIDAVGNFLLANMTILFLPPAVGLMEHFQDIKPYLFGIAIIILGALFLNILTIGLVSQWIKKRYEGDYPEIGGKNGNFNE

SEQ ID NO: 10551 - DNA, 243 bp, Streptococcus agalactiae
ttgctgacagcttctatattggttattttagaatcttttggtacaactacactcatctcaatttcagagtatgaagcagttttatttagattatttgtcaaatcaatggttgacttaaatccatataaagtagtagcaacgaaaatagaagctaatactaaaattatagttgtaaaaattctagctttattcttaatacaaagaaataaacttactaaaatgattaaaacaattacaactcca

SEQ ID NO: 10552 - protein, 81 aa, Streptococcus agalactiae
MLTASILVILESFGTTTLISISEYEAVLFRLFVKSMVDLNPYKVVATKIEANTKIIVVKILALFLIQRNKLTKMIKTITTP

SEQ ID NO: 10553 - DNA, 405 bp, Streptococcus agalactiae
atggaaaaaattaggatttaccataacccaaattgtgggacatcaaggaacgtacttgccattattcgtcattgtggtattgaaccagaaattatttattatctgaaaacaccacctagcaggatggaactggttgaactgttgttagaaatgaaactttctgcgagggaacttctaagaacagatgttcctgcttatgagaaattcaatttggaatcttctagcgttacagatgaagaaatgattgatgcgatgatacaagatcctattcttatcaatcgtcccatagttgttacgagtaaaggtgcaaaactctgccgaccctgtgaagcaattttaaccattttacctgtaaagatggaaaaagattttgttaaagaagatggacagattatccaaagttta

SEQ ID NO: 10554 - protein, 135 aa, Streptococcus agalactiae
MEKIRIYHNPNCGTSRNVLAIIRHCGIEPEIIYYLKTPPSRMELVELLLEMKLSARELLRTDVPAYEKFNLESSSVTDEEMIDAMIQDPILINRPIVVTSKGAKLCRPCEAILTILPVKMEKDFVKEDGQIIQSL

SEQ ID NO: 10555 - DNA, 126 bp, Streptococcus agalactiae
gtgctaggagtggctgttgcagttgcggttgaagctgtggagttagacaaatcttgttgtgtggttgtggtgctagtctctttgacagtggtactttcagtctggggagcttcaacattattagtt

SEQ ID NO: 10556 - protein, 42 aa, Streptococcus agalactiae
MLGVAVAVAVEAVELDKSCCVVVVLVSLTVVLSVWGASTLLV

SEQ ID NO: 10557 - DNA, 129 bp, Streptococcus agalactiae
ttgcctagcttttttatcaaaaatttcctcatatcaaatgattttcatcaatttgatagtcctttagcagaccttgaagtctatcaaattcataacaaaaatgttcaggaatatgaccgtcagagccta

SEQ ID NO: 10558 - protein, 43 aa, Streptococcus agalactiae
MPSFFIKNFLISNDFHQFDSPLADLEVYQIHNKNVQEYDRQSL

SEQ ID NO: 10559 - DNA, 414 bp, Streptococcus agalactiae
atggtaatgaaagcaattgaaatttatatgaatattaatggtcgtggggccgaagctattacattttatgaagaggcttttaatacaaaagcagaacacgtcacaacttttgcacagggttggccagattgtccgccagaacttgaacatttaattatgaacgctcaatttaatattgatggtattcgaatgcaactttctgacaataatcctatttttgattttcaaattggacaaaatatgacagcagctttaattgtggaatctgtagaagaagcgcaagagttattcaataagctttctcgagatgcaatgaacattaaaatgcctctacaagcagttccgtggagtccagcttatggaaatgtgactgacaaatatggtatgacatggcaaatcaatactgagcttagc

SEQ ID NO: 10560 - protein, 138 aa, Streptococcus agalactiae
MVMKAIEIYMNINGRGAEAITFYEEAFNTKAEHVTTFAQGWPDCPPELEHLIMNAQFNIDGIRMQLSDNNPIFDFQIGQNMTAALIVESVEEAQELFNKLSRDAMNIKMPLQAVPWSPAYGNVTDKYGMTWQINTELS

SEQ ID NO: 10561 - DNA, 495 bp, Streptococcus agalactiae
atgattatcgactttaaaaccgtttcaactaaaggtttggagacttctccagtggcagaagccttggctggtttgcgtgcaaatgaagctcgctatttctggaataaattcaaagtagcctacgaaacatttccagtatcagactatccagaattgatggcagatattaatcaccttctaaaaaatgaacgtaaccttgtttttgctgcaaagcctttagagatttcacagctttttttagagaatcgtattttatggacacatgttttctatgaggatggtttagccattaatattttatatgaattagataatcctaaaaagagagctgtaggtttaaaattatcagatggaatggatattcctattgaattagcggacaagtttaagtttgctcgtcaaaagtcaaaactcgcaggtataatacgtggttcttattttaccctaaaaggggaaaatgaaactctgatgcagcgttggttggataatatgaag

SEQ ID NO: 10562 - protein, 165 aa, Streptococcus agalactiae
MIIDFKTVSTKGLETSPVAEALAGLRANEARYFWNKFKVAYETFPVSDYPELMADINHLLKNERNLVFAAKPLEISQLFLENRILWTHVFYEDGLAINILYELDNPKKRAVGLKLSDGMDIPIELADKFKFARQKSKLAGIIRGSYFTLKGENETLMQRWLDNMK

SEQ ID NO: 10563 - DNA, 378 bp, Streptococcus agalactiae
atggagaatcactttatttatggctatcgtaccattacacgattgctcaaaaaaatccacggattgactgttaatacaaagaaagtctatcgtatcatgaaaaataatggctggctttgtcggacacgtaccaagaaagttcccaatttgggtaaagcttattatttaacagataataaattgagtcgggatttccatgccgataagcctaaggaaaagctcgtaacagatattacctacctatatttcggtaactgtaaattgtatctctcatcaattatggatctctataaccgagaaattatagcttacactatctcagattgtcaggacacggattttgtactagacacccttaatcagttaaaattgcctaaa

SEQ ID NO: 10564 - protein, 126 aa, Streptococcus agalactiae
MENHFIYGYRTITRLLKKIHGLTVNTKKVYRIMKNNGWLCRTRTKKVPNLGKAYYLTDNKLSRDFHADKPKEKLVTDITYLYFGNCKLYLSSIMDLYNREIIAYTISDCQDTDFVLDTLNQLKLPK

SEQ ID NO: 10565 - DNA, 99 bp, Streptococcus agalactiae
ttgtgctacctcatcaaaaagaagttaggacaaatagctgtcaacaattgccttttgcttatcccttcagttgatgtgataaaagatggtagttgtcat

SEQ ID NO: 10566 - protein, 33 aa, Streptococcus agalactiae
MCYLIKKKLGQIAVNNCLLLIPSVDVIKDGSCH

SEQ ID NO: 10567 - DNA, 123 bp, Streptococcus agalactiae
ttgataaatgagatacatttaatcattatggcaaaagcaagaaaaatagctgtgtcatatgcaaataacccctgtttgctctttaaaaaagacgttatccttatttctctacacacagacgga

SEQ ID NO: 10568 - protein, 41 aa, Streptococcus agalactiae
MINEIHLIIMAKARKIAVSYANNPCLLFKKDVILISLHTDG

SEQ ID NO: 10569 - DNA, 318 bp, Streptococcus agalactiae
gtgttacaatctgttttaaaagacacaaaaacgaaaggacaacctatgtcaacatttaaacgctatgatgaagaattcaaacaatctcttgttaacctttatcaaactggaaaaactcagtctgaactctgtaaagactatggggtatccacttctacgcttgcaaaatggatcaaacagtattcccaagtcaaactcgaagataattctgtacttactgccaagcaaatacaagagttacaaaaacgtaatgcgcagcttgaagaggagaaccttatcctaaaaaaagcaagtgccatattcatgcaaaacttaaag

SEQ ID NO: 10570 - protein, 106 aa, Streptococcus agalactiae
MLQSVLKDTKTKGQPMSTFKRYDEEFKQSLVNLYQTGKTQSELCKDYGVSTSTLAKWIKQYSQVKLEDNSVLTAKQIQELQKRNAQLEEENLILKKASAIFMQNLK

SEQ ID NO: 10571 - DNA, 114 bp, Streptococcus agalactiae
ttgaaaaaatccatatatcctgactttaaatccgaagctctatcaaatccgaagctctatcaaatccatttcctaaaattattaattggtttaccatttcttaagtctcctaaa

SEQ ID NO: 10572 - protein, 38 aa, Streptococcus agalactiae
MKKSIYPDFKSEALSNPKLYQIHFLKLLIGLPFLKSPK

SEQ ID NO: 10573 - DNA, 363 bp, Streptococcus agalactiae
atggaaaatcgttatcgaaccaatttgaaaaaggtgtatttgagtgatcaagaattaattatcctcaataaaaatcttgctcagagtcagtgtccaaacttttcgcattatgccagaaaaaccttactcaatcctcgtatgaattttatcacaatcgatacaagaggttttcaagacctgatttttgaaattcgtaggattggaaataatataaaccagattgcacgttcggtaaatcaaagccacctacttagtcttcaacaagtcaaagaattgcagctcggtatagcagagttagaaacacagttacaacaagattttgacataaagtgtcagcgattgagagaattttatggtcatcac

SEQ ID NO: 10574 - protein, 121 aa, Streptococcus agalactiae
MENRYRTNLKKVYLSDQELIILNKNLAQSQCPNFSHYARKTLLNPRMNFITIDTRGFQDLIFEIRRIGNNINQIARSVNQSHLLSLQQVKELQLGIAELETQLQQDFDIKCQRLREFYGHH

SEQ ID NO: 10575 - DNA, 123 bp, Streptococcus agalactiae
ttgccagaacaagtatttcatgtacatcccggtaaatctgttctactttttggtgctgtaaatattttatccattcttcaagctgctgagatggttggtggtctattttcaataatttacctc

SEQ ID NO: 10576 - protein, 41 aa, Streptococcus agalactiae
MPEQVFHVHPGKSVLLFGAVNILSILQAAEMVGGLFSIIYL

SEQ ID NO: 10577 - DNA, 117 bp, Streptococcus agalactiae
ttgggggcggagccatcaagttatcttatcgttggctgtcaaaactggaaggttttggtcagctggcgatatgatttttgggatattgtggacacaatatctgagctcgcaaagacc

SEQ ID NO: 10578 - protein, 39 aa, Streptococcus agalactiae
MGAEPSSYLIVGCQNWKVLVSWRYDFWDIVDTISELAKT

SEQ ID NO: 10579 - DNA, 339 bp, Streptococcus agalactiae
atgcttgagaaggtcttccctgaggaaacttacccaaataccattctccatagtgaccaaggttggcaataccaacatgaagtctatcaccgctttcttgcaagtaaaggcatacatccttccatgtctcgcaaagggaccagcacggataatggtatgatggaatccttctttggtgtcttgaagaaagagatgttttatggctttgagaagactttcaagtctctggatcaactggagcaagctatcaccgagtatattttttactacaacaataaatgcattaaagaaaaactaaaaggacttagtcctgttcagtatagaattaaatcctttcaa

SEQ ID NO: 10580 - protein, 113 aa, Streptococcus agalactiae
MLEKVFPEETYPNTILHSDQGWQYQHEVYHRFLASKGIHPSMSRKGTSTDNGMMESFFGVLKKEMFYGFEKTFKSLDQLEQAITEYIFYYNNKCIKEKLKGLSPVQYRIKSFQ

SEQ ID NO: 10581 - DNA, 231 bp, Streptococcus agalactiae
ttgcaagttcaaatactccatgagattaataactttattattttagccaactttactaatcgtataaacattctccaaatttctcaacatcaattgagaaatttggctttttccgttgctcagttaaagcgtcctttagttgtatatttcctgttaatatcccttttgaagcataacattgttttcaatgatcgcatccgattgttgacacccattttagaacctattctt

SEQ ID NO: 10582 - protein, 77 aa, Streptococcus agalactiae
MQVQILHEINNFIILANFTNRINILQISQHQLRNLAFSVAQLKRPLVVYFLLISLLKHNIVFNDRIRLLTPILEPIL

SEQ ID NO: 10583 - DNA, 366 bp, Streptococcus agalactiae
atgattaaaaaaaatacttgtgaaatttattgttatgacgaagaaaaggtcaatcgaatacaaggtaatttacagacagtagatatttctagtgttgcccaaatgttaaaagctattgcagataaaaatagagcaaaaattacctatgcattgtgtcaagatgacgaactgtgtgtgtgtgatattgcaaatattataggtgttacggttgcaaatacctctcatcacctgcgaacgctccataagcaagggattgttaagtttcgaaaagagggaaaacttgcattttattccttagatgatgagcatatcagacaaattatgatgattgcattggcacataagaaagaggtgaagatcaatgtc

SEQ ID NO: 10584 - protein, 122 aa, Streptococcus agalactiae
MIKKNTCEIYCYDEEKVNRIQGNLQTVDISSVAQMLKAIADKNRAKITYALCQDDELCVCDIANIIGVTVANTSHHLRTLHKQGIVKFRKEGKLAFYSLDDEHIRQIMMIALAHKKEVKINV

SEQ ID NO: 10585 - DNA, 297 bp, Streptococcus agalactiae
atgaatcagcttgagtttcagcgtaatcacctgcaaatggactattacagcgagagctaccaagattttgaacgtgacttctaccgctactccaacatgaatattccattgatcttcctgaccgatgatatcctcaaaacaatggcgacttcacgtaagaattactttgtcctgaataaggaaaagtccaaagataaccgcgatcacttcttcatatttgaagtaagaaccttagaagagaatccactaatctatcattatacatataagaaaacaactacatacttaacacaaaaa

SEQ ID NO: 10586 - protein, 99 aa, Streptococcus agalactiae
MNQLEFQRNHLQMDYYSESYQDFERDFYRYSNMNIPLIFLTDDILKTMATSRKNYFVLNKEKSKDNRDHFFIFEVRTLEENPLIYHYTYKKTTTYLTQK

SEQ ID NO: 10587 - DNA, 111 bp, Streptococcus agalactiae
ttgattaaaaaggttatggttcataagaaaaacagggctctccatcgaaagcatgggagccctgtttttatcgaaaatttatcgatctatgattttccttatacagcatac

SEQ ID NO: 10588 - protein, 37 aa, Streptococcus agalactiae
MIKKVMVHKKNRALHRKHGSPVFIENLSIYDFPYTAY

SEQ ID NO: 10589 - DNA, 456 bp, Streptococcus agalactiae; identical to SEQ ID NO: 9041

SEQ ID NO: 10590 - protein, 152 aa, Streptococcus agalactiae
MNHLLNLSKENIAKIDFDFLNEALNANIRLKELVDELKISKELDSKGWSKKDSRTIKILYDGLINKHIVSLDRADYNIIQVIPFANVHVLLFLIPERENSKNYRIYNYSDYEMELINEDRQQFSKYETVDLDQLILVDIFNIDDYISSYLTI

SEQ ID NO: 10591 - DNA, 324 bp, Streptococcus agalactiae
ttgataaactatgctgataataaaagcgatagacatattttacaaacctgtttagaatttgctcaaaaaattgtagaatcagataaatctgaatatagtattctcattttactacaaataaaaaaacgattaaacatattaacacaaatggatagcaactatcttcattctctaatgaatcaaagttcggtagaaattaggtttgctgcagcctgtattctaggtaacaaagaacaagccagatattttttcgataaagaattcgctgatgaacaaaaagaacgatttctggaatatccgatttattacctccttagcctagac

SEQ ID NO: 10592 - protein, 108 aa, Streptococcus agalactiae
MINYADNKSDRHILQTCLEFAQKIVESDKSEYSILILLQIKKRLNILTQMDSNYLHSLMNQSSVEIRFAAACILGNKEQARYFFDKEFADEQKERFLEYPIYYLLSLD

SEQ ID NO: 10593 - DNA, 306 bp, Streptococcus agalactiae
atgaatcagcttgagtttaataaaaatctattacaaatggattattttagtgatagctaccgaaaatttgaagaggatttctatcgctactcagccctagatactccacttacttttttaacagatgatattatgcttgccatggcaaaatctcaaaagccttattttaagctaaataaggaaaattcgaaagaccatcgtgaccattattttatgttcaatgtggaaccttcacgagataataatctagttaggctatattgttacgattcaacgaagacacatatttcaaaaaacaggccaaaa

SEQ ID NO: 10594 - protein, 102 aa, Streptococcus agalactiae
MNQLEFNKNLLQMDYFSDSYRKFEEDFYRYSALDTPLTFLTDDIMLAMAKSQKPYFKLNKENSKDHRDHYFMFNVEPSRDNNLVRLYCYDSTKTHISKNRPK

SEQ ID NO: 10595 - DNA, 288 bp, Streptococcus agalactiae
atgttggagcaaattctacaaagtcttttgattttcgcagcaataggactgatgttgtttgtcctttatcggattgtgaaagtttcaggtgctttgtttcttatcggactcatcagtggattagtctttattgaaatctatggaatttacctcttctttactgagagatacctctattcagaagatttagcaactaatggagtttggagttttacaggattttttattgctttgaatctatttcttgtttttagcattattatgaagtggtggagaaatagaatagtt

SEQ ID NO: 10596 - protein, 96 aa, Streptococcus agalactiae
MLEQILQSLLIFAAIGLMLFVLYRIVKVSGALFLIGLISGLVFIEIYGIYLFFTERYLYSEDLATNGVWSFTGFFIALNLFLVFSIIMKWWRNRIV

SEQ ID NO: 10597 - DNA, 351 bp, Streptococcus agalactiae
atgaacacacgtgtctttaaggacatctcaaaggttcaacacagggcatggctgggatttacaactagacaggttatttttgtatttccagctgtcgccctaaccattttggttttgggcttgaacctattttattggcaatttggggattggtttgtctatggttttgtttttagctttaccattccactcatgttatttggggtctatcgccccaacgatttaccatttgaaatatacctcaagtaccgttttcattatgaactaacggtgccagaccgcacatttactggaagaaaaggagaccaacgtgaaaaaattaaaacactcaatgaaatcaaagacctcttc

SEQ ID NO: 10598 - protein, 117 aa, Streptococcus agalactiae
MNTRVFKDISKVQHRAWLGFTTRQVIFVFPAVALTILVLGLNLFYWQFGDWFVYGFVFSFTIPLMLFGVYRPNDLPFEIYLKYRFHYELTVPDRTFTGRKGDQREKIKTLNEIKDLF

SEQ ID NO: 10599 - DNA, 120 bp, Streptococcus agalactiae
atggaacagttttatgacgggcaatctctaagcaagtcacacttaataggaccaattgtagcaagactataccctctattgtcagatactctttcaggaataaactcaccagaagaccgt

SEQ ID NO: 10600 - protein, 40 aa, Streptococcus agalactiae
MEQFYDGQSLSKSHLIGPIVARLYPLLSDTLSGINSPEDR

SEQ ID NO: 10601 - DNA, 156 bp, Streptococcus agalactiae
gtgattctgacagacaatgagaggcagacgaaggttttggtctggcttttggagaatgagctgaatcatctcattcaaacttatcgaatattgacttttaaagcgaagaaatcgtggcgacagcaactcaaaacaatccgtggttttggcaaagag

SEQ ID NO: 10602 - protein, 52 aa, Streptococcus agalactiae
MILTDNERQTKVLVWLLENELNHLIQTYRILTFKAKKSWRQQLKTIRGFGKE

SEQ ID NO: 10603 - DNA, 381 bp, Streptococcus agalactiae
atgcttgaggtatatctaggaaataataccaatacaaatcaagatttactaaccattttgacgacctatggagtggcttatcgttgtacaaaagcatgtgaggtaaaccgtgaaatcatactgtcactctttgccaaaaccacggattgttttgagttgctgtcgccacgatttcttcgctttaaaagtcaatattcgataagtttgaatgagatgattcagctcattctccaaaagccagaccaaaaccttcgtctgcctctcattgtctgtcagaatcacgtctatccagctattgggctagacgaagtacgtacttttcttcccagacaggtaaaagaagagttgtttcaggccagtctgatgaaacaagtgacaggg

SEQ ID NO: 10604 - protein, 127 aa, Streptococcus agalactiae
MLEVYLGNNTNTNQDLLTILTTYGVAYRCTKACEVNREIILSLFAKTTDCFELLSPRFLRFKSQYSISLNEMIQLILQKPDQNLRLPLIVCQNHVYPAIGLDEVRTFLPRQVKEELFQASLMKQVTG

SEQ ID NO: 10605 - DNA, 96 bp, Streptococcus agalactiae
ttgaagaaggttagggtaagtttgatttcctttttcaatccactagaaaacccgcttggattcttccaaacgggttttgtttttatctttcagaaa

SEQ ID NO: 10606 - protein, 32 aa, Streptococcus agalactiae
MKKVRVSLISFFNPLENPLGFFQTGFVFIFQK

SEQ ID NO: 10607 - DNA, 648 bp, Streptococcus agalactiae
atgtcatattttagaaattactggtatcgttttggagcaattttatttattattttagcagtaatattgcttgtttttagacctgactggtcaatgcttcactatctattgtatttttactttatggcacttctagcgcatcaatttgaagaatatcagtttcccggtggggcatcacctatcattaactatgttgtttatgatgaagaagagctgatggattgttttccaggcaatactcagtctattatgttggttaatactattgcttggttgctttacattgctagtattgcttttcctcaagcttattggcttggattaggagtcatgttctttagtctaacgcagctcttgggtcatggttttcagatgaatattaaacttaaaacttggtataatcctggtctagcaacgacagtatttctcctagtaccaatagcttgcgtatacatctatcaagctagtgcagaaggaatgctcacttggggagattggctaggtggttttatcatgttgattgtctgtgtactaactagcattattgcacctgtacagctattgaaggataaggagaccaattatattattagtccttggcaaatggaccgttttcataaggtcgttaattttgtaaggataaaaaaa

SEQ ID NO: 10608 - protein, 216 aa, Streptococcus agalactiae
MSYFRNYWYRFGAILFIILAVILLVFRPDWSMLHYLLYFYFMALLAHQFEEYQFPGGASPIINYVVYDEEELMDCFPGNTQSIMLVNTIAWLLYIASIAFPQAYWLGLGVMFFSLTQLLGHGFQMNIKLKTWYNPGLATTVFLLVPIACVYIYQASAEGMLTWGDWLGGFIMLIVCVLTSIIAPVQLLKDKETNYIISPWQMDRFHKVVNFVRIKK

SEQ ID NO: 10609 - DNA, 501 bp, Streptococcus agalactiae
atgaaagcattgataacaaaatggtacctcttttgtccctatcttgcttctctttttgccttagcattattttttggaaattgggatttacgagtgcagtcactacttatttcgggactttttattcaattacactttttcgaagaatttggtttccctggaggttttccgcttatcactatgctagttgaacttaaatcggttgaaactgatactagtaagtgggacttaaaccatctatcagcctttttcgggaatcagtggtttgcagtgattgtttatcttttgccgattttttgtcccaatataccatttttaacacttgcagtcatgatttttgcatttgcagaacttgccatgcatcttttcttttttaatctttccttgaagaagtggtataatccaggacttcttacgaccttagtaggtcttgtccctgtttctgtctattatttagctcatgattggaagttgtattctggacttgattggtttttaggc

SEQ ID NO: 10610 - protein, 167 aa, Streptococcus agalactiae
MKALITKWYLFCPYLASLFALALFFGNWDLRVQSLLISGLFIQLHFFEEFGFPGGFPLITMLVELKSVETDTSKWDLNHLSAFFGNQWFAVIVYLLPIFCPNIPFLTLAVMIFAFAELAMHLFFFNLSLKKWYNPGLLTTLVGLVPVSVYYLAHDWKLYSGLDWFLG

SEQ ID NO: 10611 - DNA, 90 bp, Streptococcus agalactiae
gtgcataaaacctccaaaggtattgatattataggttcacttgattatactatatggtatcaaatgtcacaaatcttggaggtcatctta

SEQ ID NO: 10612 - protein, 30 aa, Streptococcus agalactiae
MHKTSKGIDIIGSLDYTIWYQMSQILEVIL

SEQ ID NO: 10613 - DNA, 168 bp, Streptococcus agalactiae
atgcaacgtagcctttttggggtctttaccgcatttttagctgtgatttgtgttttatgtgcaattcctgctataaagaaaaaaagatatggattaggaacagtttttttgatgaatgctttcactaaccttgtcaacacaatccatgccttttatggaacattattt

SEQ ID NO: 10614 - protein, 56 aa, Streptococcus agalactiae
MQRSLFGVFTAFLAVICVLCAIPAIKKKRYGLGTVFLMNAFTNLVNTIHAFYGTLF

SEQ ID NO: 10615 - DNA, 216 bp, Streptococcus agalactiae
atgattaaactgtattataaagatgcttacgacactgaacgatgccaagtttttgaaaatccaaatgattttattcgagttttaatgggatgtgttactgttcctgacaattatcctattacgaaaatgacttataaagataaagatattgcttacagtggtacttatggagatctcttcaagacttttattgaatttgattggtccactttggac

SEQ ID NO: 10616 - protein, 72 aa, Streptococcus agalactiae
MIKLYYKDAYDTERCQVFENPNDFIRVLMGCVTVPDNYPITKMTYKDKDIAYSGTYGDLFKTFIEFDWSTLD

SEQ ID NO: 10617 - DNA, 129 bp, Streptococcus agalactiae
gtgctagttgcactcctattagtggaagtaggagttgaattgttagaagtgaccaagtttgcatctgtggccgttacacctgttggagttgttgcagatgtaacactagttgtctcatctgcaagtacc

SEQ ID NO: 10618 - protein, 43 aa, Streptococcus agalactiae
MLVALLLVEVGVELLEVTKFASVAVTPVGVVADVTLVVSSAST

SEQ ID NO: 10619 - DNA, 492 bp, Streptococcus agalactiae
atgattaaatggaatgaaaaagaaacaaaactagttgatacaagtttttcaattatgttgtatctaaaaacgctatttgcagtcggacaagtagtagctggcgttttattatattattttaaacctacacaaataaaacatctcctatttcttttaactgaaggtgaagttcacggtgggattcatggttttatttctgctcatttcttgaaaataagcagttatattaatgattcggctagtcatttagccgctatctatctattaattcatggcggtatcaaattagtagcacttattttattacataaagagaaattatttgcttaccctttatcaattttagttttcgttgggtttatcattttccaactaagggaatatttttctagtcatagcattttaatgatttttctatgtgtatttgatgttatcatgataattttaacatggttagaatatcagaaaatgaaattgaatttttcaaaaagg

SEQ ID NO: 10620 - protein, 164 aa, Streptococcus agalactiae
MIKWNEKETKLVDTSFSIMLYLKTLFAVGQVVAGVLLYYFKPTQIKHLLFLLTEGEVHGGIHGFISAHFLKISSYINDSASHLAAIYLLIHGGIKLVALILLHKEKLFAYPLSILVFVGFIIFQLREYFSSHSILMIFLCVFDVIMIILTWLEYQKMKLNFSKR

SEQ ID NO: 10621 - DNA, 99 bp, Streptococcus agalactiae
ttgattccaaaagacattgctttcttaaccaaagctcgtcctgtcttagagaatgaagatagtaacgtttcagaagtgacaccttctaaatttttaaca

SEQ ID NO: 10622 - protein, 33 aa, Streptococcus agalactiae
MIPKDIAFLTKARPVLENEDSNVSEVTPSKFLT

SEQ ID NO: 10623 - DNA, 171 bp, Streptococcus agalactiae
ttgaataatgactctgccacgctaaaaactcttgaaatagctcatgatttttatctaagcaaagggggtaaatcaaactatcttcatgtgtatttatataccccacaagcgtctcaagattttcaaattgtgcatcataatggtgaatcacatggtttagctccttcgaga

SEQ ID NO: 10624 - protein, 57 aa, Streptococcus agalactiae
MNNDSATLKTLEIAHDFYLSKGGKSNYLHVYLYTPQASQDFQIVHHNGESHGLAPSR

SEQ ID NO: 10625 - DNA, 180 bp, Streptococcus agalactiae
ttggcagcagaatttgaactgctactcggagtactactagcagaggaattttctagtgtttggctggatgatgcccttgtctcatctttttcagtagaaacttggttactagaattttgtccactttctcttataatgacggtttttgaagtagaagaatcagtcttactagagtctttg

SEQ ID NO: 10626 - protein, 60 aa, Streptococcus agalactiae
MAAEFELLLGVLLAEEFSSVWLDDALVSSFSVETWLLEFCPLSLIMTVFEVEESVLLESL

SEQ ID NO: 10627 - DNA, 198 bp, Streptococcus agalactiae
atgccaaaacaaaaaacacaccgcgcatcagctaaacgctttaaacgcacaggttcaggtggattgaaacgcttccgcgcgtttacttcacaccgtttccacggtaaaactaaaaaacaacgtcgtcatcttcgtaaagctactatggtttcatcaggagatttcaaacgtattaaagcaatgcttactcgccttaaa

SEQ ID NO: 10628 - protein, 66 aa, Streptococcus agalactiae
MPKQKTHRASAKRFKRTGSGGLKRFRAFTSHRFHGKTKKQRRHLRKATMVSSGDFKRIKAMLTRLK

SEQ ID NO: 10629 - DNA, 681 bp, Streptococcus agalactiae
atgaactcaattaatattgctattgatggaccagcatcaagtggaaaaagtactgtcgctaagattattgctaaaaatttgaattacacttaccttgatacaggtgctatgtatcgttgtgctacttatctggctttacagcatggatatgaagcacaagatgtttcgaaaattctaggactcctagctgaaagaccaatttcttttggtaaagcagaagatggcagccagacagtctttcttggcacagaagaagttactttagctatccgtcaaaacgatgttactaacaatgtctcgtgggtttctgctatcccagagattcgagaagagttagtaaaccagcagcgtcgtatagccaaagatggtgctattataatggatggtcgtgacataggaacagttgttttgccagatgcagaattgaagatttttttagtggcttctgttgatgaaagagctgagcgtcgctttaaagaaaatcaagaaaaaggcattgagagtgattttgaaacactgaaatcagaaattgctgctcgtgattataaagatagccatcgagaagtttcaccattaaaggcagcagaagatgctattgaatttgatactacaggagtatcaattgaaggtgttgtaacttttattcaagaaaaagcagaaaaaataattgacatgaagaat

SEQ ID NO: 10630 - protein, 227 aa, Streptococcus agalactiae
MNSINIAIDGPASSGKSTVAKIIAKNLNYTYLDTGAMYRCATYLALQHGYEAQDVSKILGLLAERPISFGKAEDGSQTVFLGTEEVTLAIRQNDVTNNVSWVSAIPEIREELVNQQRRIAKDGAIIMDGRDIGTVVLPDAELKIFLVASVDERAERRFKENQEKGIESDFETLKSEIAARDYKDSHREVSPLKAAEDAIEFDTTGVSIEGVVTFIQEKAEKIIDMKN

SEQ ID NO: 10631 - DNA, 501 bp, Streptococcus agalactiae
atggttcagggttcaattaatattgaaaaatataaagatttggcgctccaaaaacaaggcgagcatcgtaaatttttagcaagtttaaaaaagaaagctcctaaaaacttagataaaatagtccaacagatacatcaagaggtttttcaagaaattgattgtacagcatgtgctaattgttgtaaaactttgggtcctctatttacagaagctgatatttctaggatttctaaacatttccggatgaagttatcggcttttgaagatttatttttagaagtagatgaagatggagataaagtatttaaagcgatgccttgtccgtttttaggcgatgataacttatgtagtatatacgatgtcagacctaaagcttgtcgtgaatttccacatactgatcgtaagaaaatctatcaaattaataacttaacgataaaaaatactcttacttgtccagcggcatacctttttgtggaaaaattgaaatcacgtatagggaaa

SEQ ID NO: 10632 - protein, 167 aa, Streptococcus agalactiae
MVQGSINIEKYKDLALQKQGEHRKFLASLKKKAPKNLDKIVQQIHQEVFQEIDCTACANCCKTLGPLFTEADISRISKHFRMKLSAFEDLFLEVDEDGDKVFKAMPCPFLGDDNLCSIYDVRPKACREFPHTDRKKIYQINNLTIKNTLTCPAAYLFVEKLKSRIGK

SEQ ID NO: 10633 - DNA, 804 bp, Streptococcus agalactiae
atgtcaaaaaaaataatattaggaattttatctcttttatctgtcgttactttggtggcgtgtggttcatcagacaaacagctacaagataaagttgagaaaaaagggaagttagttttagcggtgagtccagattatgctccctttgagtttaaagcgcttgttaatgggaaagataaagttgtcggcgcagatattgagttagctcaagctattgctgatgagcttcatgtcaaactagaggtatctcctatgagttttgacaatgttttatcaagtttacaaacaggtaaggctgatatggctatttctggattatcatatactaaagagcgtgctaaagtctatgatttttcaaaaccttattacactacagaaaatgcggttcttgttaggaagtctgatttaggaaaatatacttcaatcgaaagccttaaaggtaaaaaaatagcagtacaaaaaggaagtatcgaagagggagtttctaagaaatcattcaaaaattctcacgtcgtgtcactgacagcgatgggagaagcgattagtgagttaaaatcaggcaaggtagaagctgttgatttagaaaaaaccgtagctgaaggttacttggcccagaatccagaccttgttcttgctaagtttgcccttaaaacaggagaaggggatgctaaggctgtagctttacctaaagacagtggaaaaatgttgaagactgttaacaaagtgataaagagacttgaaaaagaagataaatataaagtttatatttcagatgcggctaaattaactggcaatcaagttgaa

SEQ ID NO: 10634 - protein, 268 aa, Streptococcus agalactiae
MSKKIILGILSLLSVVTLVACGSSDKQLQDKVEKKGKLVLAVSPDYAPFEFKALVNGKDKVVGADIELAQAIADELHVKLEVSPMSFDNVLSSLQTGKADMAISGLSYTKERAKVYDFSKPYYTTENAVLVRKSDLGKYTSIESLKGKKIAVQKGSIEEGVSKKSFKNSHVVSLTAMGEAISELKSGKVEAVDLEKTVAEGYLAQNPDLVLAKFALKTGEGDAKAVALPKDSGKMLKTVNKVIKRLEKEDKYKVYISDAAKLTGNQVE

SEQ ID NO: 10635 - DNA, 243 bp, Streptococcus agalactiae
atgaagcattggtacacagatgaaggcatccgctatttggtattcctttataaaacatatgatttttcaggtgaattacaatcgtcagatgaaggtgatgttgtatggattgaacgttcacaacttgataagattgaactagcatatgatatgcttaactttttgagagtatttgacgaagatgacatctcagagatgttttatagtaagcgacttgaagatggttttataagaaaattttat

SEQ ID NO: 10636 - protein, 81 aa, Streptococcus agalactiae
MKHWYTDEGIRYLVFLYKTYDFSGELQSSDEGDVVWIERSQLDKIELAYDMLNFLRVFDEDDISEMFYSKRLEDGFIRKFY

SEQ ID NO: 10637 - DNA, 186 bp, Streptococcus agalactiae
ttgaaaaaaaagaatttacttcaggagagtattaataaacgtctatctgaagagcgatatcaaattcctaaagaaaaaagagagaaaaaacgatttgacatgcagcttattctgattatttctattttaatagggttaatcatgtctattatcggaattattcgatttttcttaacctacagtagt

SEQ ID NO: 10638 - protein, 62 aa, Streptococcus agalactiae
MKKKNLLQESINKRLSEERYQIPKEKREKKRFDMQLILIISILIGLIMSIIGIIRFFLTYSS

SEQ ID NO: 10639 - DNA, 144 bp, Streptococcus agalactiae
gtgaaagtaaagaagtgtttttcaaatgttggctcaggtaacagatacgtttcaaaattaaacacctcattccaatctagttgctcatattgccaccatgtctccctaaaccttgaagaagaaaaagtattccatggtttatca

SEQ ID NO: 10640 - protein, 48 aa, Streptococcus agalactiae
MKVKKCFSNVGSGNRYVSKLNTSFQSSCSYCHHVSLNLEEEKVFHGLS

SEQ ID NO: 10641 - DNA, 372 bp, Streptococcus agalactiae
ttggcagtatctaaaaacatactcatttctaaaattcctattctttattctattcagtataaaaaaacgctttacagcgtttctcattacatgattgcactaatagcaccaaataccaaaccaccaactgttactagtaccatcaaaataacaacaaaaagagttagtttttcaaacccagttttttttcgttgtccgttatctccaaaagccactcatgtcacctcatttactgaatatatagttaagtctatattaacacgaaacgtcttatttcgcaaactacaaaccgttagcttaaatatatctttattaaatcaatatatctttattaaatcgcttccatatttccttgtgctttataagagttta

SEQ ID NO: 10642 - protein, 124 aa, Streptococcus agalactiae
MAVSKNILISKIPILYSIQYKKTLYSVSHYMIALIAPNTKPPTVTSTIKITTKRVSFSNPVFFRCPLSPKATHVTSFTEYIVKSILTRNVLFRKLQTVSLNISLLNQYIFIKSLPYFLVLYKSL

SEQ ID NO: 10643 - DNA, 291 bp, Streptococcus agalactiae
ttgaatcttaataagttttatgttagaatgtactttgaccatagtggaggaattaacatgtataacctattactcaccattctacttgttttatcagtattattgattatctcaattttcatgcaaccacaaaagaatccaagtagtaatgtttttgatagtagcggttctgaagccctttttgaacgtagtaaagctcgaggatttgaagcttttatgcaacgttttacaggtgttttagtctttttctggctactaatcggcttagtattatctattttatcaagtcat

SEQ ID NO: 10644 - protein, 97 aa, Streptococcus agalactiae
MNLNKFYVRMYFDHSGGINMYNLLLTILLVLSVLLIISIFMQPQKNPSSNVFDSSGSEALFERSKARGFEAFMQRFTGVLVFFWLLIGLVLSILSSH

SEQ ID NO: 10645 - DNA, 174 bp, Streptococcus agalactiae
atgtctaaaaagactgattcaaattatctacattccaattgttctgacaagaaaatttggagcgatgaggcgcctctgcaacaggagactatccctaaagacagagattgtgttatcaaacctgtcattactatgacagttgaacatgtggaaatcccattagatgaccaatct

SEQ ID NO: 10646 - protein, 58 aa, Streptococcus agalactiae
MSKKTDSNYLHSNCSDKKIWSDEAPLQQETIPKDRDCVIKPVITMTVEHVEIPLDDQS

SEQ ID NO: 10647 - DNA, 198 bp, Streptococcus agalactiae
atgatcatgctgttcctaatgattaaaccagattatataaggtatttcaaagtcattgacgatatgcatgataccatgtaccaacagactgtttttcatgttcaactgcaagcttggaaatacaccatgaaatcgattgatcaattagttgtagatgatttgaatcatatcagtaatgagaaaaccactttggttaaa

SEQ ID NO: 10648 - protein, 66 aa, Streptococcus agalactiae
MIMLFLMIKPDYIRYFKVIDDMHDTMYQQTVFHVQLQAWKYTMKSIDQLVVDDLNHISNEKTTLVK

SEQ ID NO: 10649 - DNA, 186 bp, Streptococcus agalactiae
atgagtggtcaaagagctaccagcaccatccagagcgatataaatatctttcatcatatagaagctatttgtataagtaaatctaacagtattgggctccccgcaatacaaaatcacttgggacagctgatccaaagagaacgtctgggtcttttcttctcgataacctattccaaagctcccact

SEQ ID NO: 10650 - protein, 62 aa, Streptococcus agalactiae
MSGQRATSTIQSDINIFHHIEAICISKSNSIGLPAIQNHLGQLIQRERLGLFFSITYSKAPT

SEQ ID NO: 10651 - DNA, 96 bp, Streptococcus agalactiae
atgttaaaagatgttaatgttggaatgagtcatttattagttagaggtgctattattctagtagtagggattgtttttctgttgcaacagattcag

SEQ ID NO: 10652 - protein, 32 aa, Streptococcus agalactiae
MLKDVNVGMSHLLVRGAIILVVGIVFLLQQIQ

SEQ ID NO: 10653 - DNA, 135 bp, Streptococcus agalactiae
gtgattagtctctcaatcttattacttagagtaaatcaagcaaaaatgttagaaaataaaaaatatatgacaaactattccaaacaatatgctcgccaatcgaataatgaatggattttgtatagtggtgcaaac

SEQ ID NO: 10654 - protein, 45 aa, Streptococcus agalactiae
MISLSILLLRVNQAKMLENKKYMTNYSKQYARQSNNEWILYSGAN

SEQ ID NO: 10655 - DNA, 252 bp, Streptococcus agalactiae
ttgtttgtcatgagaacatttgggaactccctgagtggtcccttggttgtgatcttatcttctatactatttagctggtctcacttacatggtctatctgtcgtcgactttgttgtctattttggtatgggtttgattttcgctagtttgcaccactatacaaaatccattcattattcgattggcgagcatattgtttggaatagtttgtcatatattttttattttctaacatttttgcttgatttactc

SEQ ID NO: 10656 - protein, 84 aa, Streptococcus agalactiae
MFVMRTFGNSLSGPLVVILSSILFSWSHLHGLSVVDFVVYFGMGLIFASLHHYTKSIHYSIGEHIVWNSLSYIFYFLTFLLDLL

SEQ ID NO: 10657 - DNA, 330 bp, Streptococcus agalactiae
ttgcttgggcattgggtgattagtttactatcaatagggttagagtggagttggagtatatggattggcattaatcttataatgatgattctgttgagttatgtgctaacaaaaactgagccaatcagtaactaccaagagtcatcatctaacctcaaaaaatggctatttgcaataggtgcttttagcgttttattttgctgggcactactagtaaaaacatttttcccaataaggcaaaaccaggagggattaatagctgatatgaatcaggtcaatcactactttcgagttgtcttattattgactatctgtcttattgccccaatt

SEQ ID NO: 10658 - protein, 110 aa, Streptococcus agalactiae
MLGHWVISLLSIGLEWSWSIWIGINLIMMILLSYVLTKTEPISNYQESSSNLKKWLFAIGAFSVLFCWALLVKTFFPIRQNQEGLIADMNQVNHYFRVVLLLTICLIAPI

SEQ ID NO: 10659 - DNA, 114 bp, Streptococcus agalactiae
atgggaaatactaggtgtgactttaaagaacttctaacttttattgatatgttgttaggcattcttgtagaaacaaatgttaagaaaataaggagttctcatttgtatatttta

SEQ ID NO: 10660 - protein, 38 aa, Streptococcus agalactiae
MGNTRCDFKELLTFIDMLLGILVETNVKKIRSSHLYIL

SEQ ID NO: 10661 - DNA, 96 bp, Streptococcus agalactiae
atgtttgtaatgggtgtccaaagaggaggatcaactgtggttacaagaagaccttctatcttgctaagcaagctcaaagaaactatgaaaaacttt

SEQ ID NO: 10662 - protein, 32 aa, Streptococcus agalactiae
MFVMGVQRGGSTVVTRRPSILLSKLKETMKNF

SEQ ID NO: 10663 - DNA, 159 bp, Streptococcus agalactiae
ttgcaatggtattcaaaagagctgaaattaaaaattttaaggaaattggaagtatcttacttctttattccaatagctaaatcggagattataaaaggttgccaaatttttctttggcaacctttttatattattacttataaatcatggaaactagca

SEQ ID NO: 10664 - protein, 53 aa, Streptococcus agalactiae
MQWYSKELKLKILRKLEVSYFFIPIAKSEIIKGCQIFLWQPFYIITYKSWKLA

SEQ ID NO: 10665 - DNA, 243 bp, Streptococcus agalactiae
ttgaataaacaagagcgtttaggaatgagcgtttatctttactataatcgtgacgctcgtaaattatataaatacggagatgttcattatcattctcgtagattaagatatctagtcatttatgttaataaagaggatattgttagcgttagtaaagagataaaacatttaaaatttgttaaggatgttcggttatcagcaattgatgatattgatcaggattttgttggaaacttatatcgt

SEQ ID NO: 10666 - protein, 81 aa, Streptococcus agalactiae
MNKQERLGMSVYLYYNRDARKLYKYGDVHYHSRRLRYLVIYVNKEDIVSVSKEIKHLKFVKDVRLSAIDDIDQDFVGNLYR

SEQ ID NO: 10667 - DNA, 111 bp, Streptococcus agalactiae
atgatctggaaaatggaccaaatttctaacagtttattctcaataggtgttcccgataatgcaaaacagtttttgacctcaaaagatctcaagctatgggctattttagtt

SEQ ID NO: 10668 - protein, 37 aa, Streptococcus agalactiae
MIWKMDQISNSLFSIGVPDNAKQFLTSKDLKLWAILV

SEQ ID NO: 10669 - DNA, 111 bp, Streptococcus agalactiae
atgattattgaaaaccctaacaaagcggacaaacaagaaaatctgtccattccagaaaaggcttacaaattttataataaaagagaattaaacataaaaggagtttccaaa

SEQ ID NO: 10670 - protein, 37 aa, Streptococcus agalactiae
MIIENPNKADKQENLSIPEKAYKFYNKRELNIKGVSK

SEQ ID NO: 10671 - DNA, 114 bp, Streptococcus agalactiae
gtgcttcagtcttatttacgccctcttggtgattttatttatttatcaagaaatcagacacataccaaatcaataaactatttgagaaagcaggttatttgtgataaaatgagt

SEQ ID NO: 10672 - protein, 38 aa, Streptococcus agalactiae
MLQSYLRPLGDFIYLSRNQTHTKSINYLRKQVICDKMS

SEQ ID NO: 10673 - DNA, 90 bp, Streptococcus agalactiae
atggggaatggcattgtgggacgaaaacttttcaaacttatttttatttggatttattttttcaaacagtttattttttataaagttcat

SEQ ID NO: 10674 - protein, 30 aa, Streptococcus agalactiae
MGNGIVGRKLFKLIFIWIYFFKQFIFYKVH

SEQ ID NO: 10675 - DNA, 228 bp, Streptococcus agalactiae
atgggaataaaaagttatagacgggttgagcttgtagcaaaacttaattttagatattatctagttagtattagtggacgttattacattattgattatgccaatcctagtgatataaaagattattttataggtatttttccagaaagagtagaaaaatatcaaatttatgatgtgactgcggattataagaattttttagtaaacaaaaaaagtcgcctttatctt

SEQ ID NO: 10676 - protein, 76 aa, Streptococcus agalactiae
MGIKSYRRVELVAKLNFRYYLVSISGRYYIIDYANPSDIKDYFIGIFPERVEKYQIYDVTADYKNFLVNKKSRLYL

SEQ ID NO: 10677 - DNA, 123 bp, Streptococcus agalactiae
ttgaaaacggaaatagaaacaaataatcttattaatttaggatggtttcatgataatgctgtttattatgatatgaaaacgaaaaaattatataaatctaatctaaaaaaaatagcacaggta

SEQ ID NO: 10678 - protein, 41 aa, Streptococcus agalactiae
MKTEIETNNLINLGWFHDNAVYYDMKTKKLYKSNLKKIAQV

SEQ ID NO: 10679 - DNA, 237 bp, Streptococcus agalactiae
atggctcaacaacgtcgtggcggattcaaacgccgtaaaaaagttgattatatcgcagctaacaagattgaatatgttgattacaaagatacagagcttcttagccgtttcgtttcagaacgtggaaaaattttaccacgtcgtgtaacaggaacttcagctaaaaaccaacgtaaagtaacaacagcaatcaaacgtgctcgtgttatggctcttatgccttacgtaaatgaagat

SEQ ID NO: 10680 - protein, 79 aa, Streptococcus agalactiae
MAQQRRGGFKRRKKVDYIAANKIEYVDYKDTELLSRFVSERGKILPRRVTGTSAKNQRKVTTAIKRARVMALMPYVNED

SEQ ID NO: 10681 - DNA, 489 bp, Streptococcus agalactiae
atgattaataatgtagtacttgtaggtcgcatgacccgtgatgcagaacttcgttatacaccaagtaatcaagcggtagccactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtgtctatgtaacagaagttgttgcggaaagtttccaattattggaaagtcgtgctacacgagaaggtggttcacctaactcttataataacggtggctataacaatgctccgtcaaataatagttattcagcttcttctcaacaaacacctaattttagtcgtgatgagagtccgtttggtaactcaaatccaatggatatttcagatgatgatctaccattc

SEQ ID NO: 10682 - protein, 163 aa, Streptococcus agalactiae
MINNVVLVGRMTRDAELRYTPSNQAVATFSLAVNRNFKNQSGEREADFINCVIWRQQAENLANWAKKGALVGITGRIQTRNYENQQGQRVYVTEVVAESFQLLESRATREGGSPNSYNNGGYNNAPSNNSYSASSQQTPNFSRDESPFGNSNPMDISDDDLPF

SEQ ID NO: 10683 - DNA, 357 bp, Streptococcus agalactiae
atgaaacttctcactaaagaacggtttgatgattctcaacacttttggtaccagatcaatttattacaagagagtaacttcggagcagtttttgaccatgataataaaaacattccacaggttgttgcaactattgttgatgatttacaaggttccggaagttcgaattatttctggtattttggcaatactactgatacttccatccttatgattgctcatttaaatcgaaaattctatattcaggttaatttaaaggactttgactttgcactcaatttaatagctataaataattggaagagtctcctccaaactcaactcgaagctctaaacgataccctagcaatatttcaa

SEQ ID NO: 10684 - protein, 119 aa, Streptococcus agalactiae
MKLLTKERFDDSQHFWYQINLLQESNFGAVFDHDNKNIPQVVATIVDDLQGSGSSNYFWYFGNTTDTSILMIAHLNRKFYIQVNLKDFDFALNLIAINNWKSLLQTQLEALNDTLAIFQ

SEQ ID NO: 10685 - DNA, 123 bp, Streptococcus agalactiae
atgacattaatcagtctccctcgcgttgctttgtcactccattctaccttatttattgaaatattgctagggtatcgtttagagcttcgagttgagtttggaggagactcttccaattattta

SEQ ID NO: 10686 - protein, 41 aa, Streptococcus agalactiae
MTLISLPRVALSLHSTLFIEILLGYRLELRVEFGGDSSNYL

SEQ ID NO: 10687 - DNA, 102 bp, Streptococcus agalactiae
ttgttgttatacttagttcataaaataaataacccaaaagaaagaggtaattcttatgaacaaacttattacagaaaaaaaagtcaacaacgtctcaactgc

SEQ ID NO: 10688 - protein, 34 aa, Streptococcus agalactiae
MLLYLVHKINNPKERGNSYEQTYYRKKSQQRLNC

SEQ ID NO: 10689 - DNA, 105 bp, Streptococcus agalactiae
atgcttgttttattaagtgtttatactaaagataatggtatgggatatcaagaagaattatgtatgcataaaaggttaaaatggttagtggcagctatgtgttta

SEQ ID NO: 10690 - protein, 35 aa, Streptococcus agalactiae
MLVLLSVYTKDNGMGYQEELCMHKRLKWLVAAMCL

SEQ ID NO: 10691 - DNA, 1008 bp, Streptococcus agalactiae
atggtagttaaagttggtattaacggtttcggtcgtatcggtcgtcttgcattccgtcgcatccaaaacgtagaaggtgttgaagttactcgtatcaacgaccttacagatccaaacatgcttgcacacttgttgaaatatgacacaactcaaggtcgtttcgacggtactgttgaagttaaagaaggtggattcgaagttaacggtcaatttgttaaagtttctgctgaacgcgaaccagcaaacattgactgggctactgatggcgtagaaatcgttcttgaagcaactggtttctttgcatcaaaagaaaaagctgaacaacacatccatgaaaatggtgctaaaaaagttgttatcacagctcctggtggaaacgacgttaaaacagttgttttcaacactaaccacgatatccttgatggaactgaaacagttatctcaggtgcttcatgtactacaaactgtcttgctccaatggctaaagctttacaagacaactttggtgttaaacaaggtttgatgactactatccacgcatacactggtgaccaaatgatccttgacggaccacaccgtggtggtgaccttcgtcgtgctcgtgcaggtgctgcaaacatcgttcctaactcaactggtgctgcaaaagctatcggacttgttatcccagaattgaacggtaaacttgatggtgctgcacaacgtgttcctgttccaactggatcagtaactgaattggttgcaactcttgaaaaagacgtaactgtcgaagaagtaaatgcagctatgaaagcagcagctaacgattcatacggttatactgaagatccaatcgtatcatctgatatcgttggtatttcatacggttcattgtttgatgctactcaaactaaagttcaaactgttgacggtaaccaattggttaaagttgtttcatggtacgataacgaaatgtcatacacttcacaacttgttcgtacacttgaatactttgcaaaaattgcaaaa

SEQ ID NO: 10692 - protein, 336 aa, Streptococcus agalactiae
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVATLEKDVTVEEVNAAMKAAANDSYGYTEDPIVSSDIVGISYGSLFDATQTKVQTVDGNQLVKVVSWYDNEMSYTSQLVRTLEYFAKIAK

SEQ ID NO: 10693 - DNA, 2076 bp, Streptococcus agalactiae
atggctcgcgaattttcacttgaaaaaactcgtaatatcggtatcatggctcacgtcgatgctggtaaaacaacaacaactgagcgtattctttactatactggtaaaatccacaaaatcggtgaaacacacgaaggtgcttcacaaatggactggatggaacaagaacaagaacgtggtatcacaattacatcagctgcaacaacagcacaatgggatggtcaccgtgttaacatcatcgatacaccaggacacgtggacttcacaattgaagttcaacgttcacttcgcgtacttgatggtgcggtaacagttcttgatgctcaatcaggtgtagaacctcaaactgaaacagtttggcgtcaagcaacagaatacggagttccacgtatcgtttttgctaataaaatggataaaatcggtgctgacttcctctattcagtacaatcacttcatgaccgtcttcaagcgaatgcacacccaattcaattgccaattggttcagaagacgatttccgtggtattattgacttaatcaaaatgaaagctgaaatctatactaatgaccttggtacagatatccttgaagaagatattccagcagagtatgttgatcaagcaaatgaatatcgtgaaaaattagtagaagcagttgctgatactgatgaagatttgatgatgaaataccttgaaggtgaagaaatcactaacgaagagttgatggctgctattcgtaaagcaactatcaatgttgaattctaccctgtattgtgtggttcagccttcaagaataaaggtgttcaattgatgcttgatgctgttattgattaccttccaagcccacttgatattcctgcaatcaaaggtattaaccctgatactgacgaagaagaaacacgtcctgcttcagatgaagagccatttgcagcgcttgccttcaagatcatgacagatcctttcgtgggtcgcttaacattcttccgtgtgtactcaggtgttcttaattcaggttcatacgtgttgaatacatctaaaggtaaacgtgaacgtatcggacgtatcttacaaatgcacgcaaatagtcgtcaagaaattgaaactgtttatgctggggatatcgcagcggctgttggtttgaaagatacaactacaggtgattcattgactgatgaaaaatcaaaagttattcttgaatcaattgaagttccagaaccagttatccaattgatggttgagccaaaatctaaagctgaccaagataaaatgggtatcgcccttcaaaaacttgctgaagaagatccaacgttccgcgttgaaactaacgttgaaactggtgaaacagttatctcaggaatgggtgaacttcaccttgatgtccttgttgaccgtatgaaacgtgaattcaaagttgaagcaaacgttggtgcacctcaagtatcataccgcgaaacattccgcgcttctacacaagcacgtggattcttcaaacgccaatctggtggtaaaggtcaatttggtgatgtttggattgaatttacaccaaacgaagaaggtaaaggattcgaattcgaaaatgctatcgtcggtggtgtggttcctcgtgaatttattccagccgttgaaaaaggacttgtagaatctatggcaaacggtgttcttgctggatatccaatggttgacgtaaaagctaaactttacgatggttcataccatgatgttgactcatctgagacagccttcaagattgctgcatcacttgcacttaaagaagctgctaaatcagcgcaaccagctatccttgagccaatgatgcttgttacaattacagctccagaagacaatcttggtgacgttatgggtcacgtgactgcacgtcgcggtcgtgttgatggtatggaagcacgtggtaatacacaagttgttcgtgcctttgttccacttgctgaaatgtttggttatgcaacagttcttcgttctgcaacacaaggacgtggcacattcatgatggtatttgaccactacgaagatgttcctaagtcagttcaagaagaaatcatcaagaaaaactctggtgaa

SEQ ID NO: 10694 - protein, 692 aa, Streptococcus agalactiae
MAREFSLEKTRNIGIMAHVDAGKTTTTERILYYTGKIHKIGETHEGASQMDWMEQEQERGITITSAATTAQWDGHRVNIIDTPGHVDFTIEVQRSLRVLDGAVTVLDAQSGVEPQTETVWRQATEYGVPRIVFANKMDKIGADFLYSVQSLHDRLQANAHPIQLPIGSEDDFRGIIDLIKMKAEIYTNDLGTDILEEDIPAEYVDQANEYREKLVEAVADTDEDLMMKYLEGEEITNEELMAAIRKATINVEFYPVLCGSAFKNKGVQLMLDAVIDYLPSPLDIPAIKGINPDTDEEETRPASDEEPFAALAFKIMTDPFVGRLTFFRVYSGVLNSGSYVLNTSKGKRERIGRILQMHANSRQEIETVYAGDIAAAVGLKDTTTGDSLTDEKSKVILESIEVPEPVIQLMVEPKSKADQDKMGIALQKLAEEDPTFRVETNVETGETVISGMGELHLDVLVDRMKREFKVEANVGAPQVSYRETFRASTQARGFFKRQSGGKGQFGDVWIEFTPNEEGKGFEFENAIVGGVVPREFIPAVEKGLVESMANGVLAGYPMVDVKAKLYDGSYHDVDSSETAFKIAASLALKEAAKSAQPAILEPMMLVTITAPEDNLGDVMGHVTARRGRVDGMEARGNTQVVRAFVPLAEMFGYATVLRSATQGRGTFMMVFDHYEDVPKSVQEEIIKKNSGE

SEQ ID NO: 10695 - DNA, 468 bp, Streptococcus agalactiae
atgagtcgtaaaaatcaagcgcctaaacgcgaagtattgccagatccattgtataactcaaaaatcgttacacgtcttatcaaccgtgtaatgcttgatggtaaacgtggtactgctgcaactatcgtatatgatgcttttgaagcaattaaagaagctactggaacagatgctcttgaagtgttcgaaacagctatggaaaacatcatgcctgtccttgaggtacgtgcacgccgtgttggtggatcaaactaccaagttcctgtcgaagttcgtccagaacgtcgtacaactttaggacttcgttggttggttaacgcatcacgtgctcgtggtgaacacactatgaaagatcgtcttgcaaaagaaatcatggatgctgcaaacaacacaggagcatcagttaagaaacgtgaagatactcacaaaatggctgaagctaaccgtgcctttgcacacttccgttgg

SEQ ID NO: 10696 - protein, 156 aa, Streptococcus agalactiae
MSRKNQAPKREVLPDPLYNSKIVTRLINRVMLDGKRGTAATIVYDAFEAIKEATGTDALEVFETAMENIMPVLEVRARRVGGSNYQVPVEVRPERRTTLGLRWLVNASRARGEHTMKDRLAKEIMDAANNTGASVKKREDTHKMAEANRAFAHFRW

SEQ ID NO: 10697 - DNA, 93 bp, Streptococcus agalactiae
atggtatgtttagtaactgatcaaaatagccggctaaacgaatacgaaaatctatcaggaggtattcaacgtgaaacgtacttatcaaccaag

SEQ ID NO: 10698 - protein, 31 aa, Streptococcus agalactiae
MVCLVTDQNSRLNEYENLSGGIQRETYLSTK

SEQ ID NO: 10699 - DNA, 117 bp, Streptococcus agalactiae
atgtatggtctctttatgtcaacacctttgcttagagatattttaattagcccacaccattattgttatggcattattgaattatttaaagacttattagtattaatattacaactt

SEQ ID NO: 10700 - protein, 39 aa, Streptococcus agalactiae
MYGLFMSTPLLRDILISPHHYCYGIIELFKDLLVLILQL

SEQ ID NO: 10701 - DNA, 471 bp, Streptococcus agalactiae; identical to SEQ ID NO: 9025

SEQ ID NO: 10702 - protein, 157 aa, Streptococcus agalactiae
MGGNEILINKRLRTISLLHYLLALLLLIDIIFTIDFIIHTSTISKNSLSYISYGQGFGWSMILINLIALPICFLVELSAGLLLKLEMHKQHGYYPLERLLMTGNILTVVSLVLLHTLIHNINSLLFLSITVVLLISGKSLSLISIYLLKRKSKHQKV

SEQ ID NO: 10703 - DNA, 489 bp, Streptococcus agalactiae
atgattataagacctgtcctaccctcagatgctaaagaattacttgctatctatgctccctacgttgctgacactacaataacgtttgaatacgatattcctagtatatcggaattcactaatcgtatcaaaaatatcagcaaatctttcccatatttagttgctgaagaaaatgggaaaatattaggttatgcatatgcttcaacttactacgctagagctgcctatgactggacttgcgagctttctatttaccttgataaagatgcacgtagcaaaaaaattggtagccaactatatgatacattggagaaagaattagttaaccaagggtatgttaatctactcgcttgtatcagtttaccaaatgatataagcattgcattccacaaaaaaagaggatttaatcaagtcgcacatttcccaaaaatcggatttaaatttgaacaatggcatgacattgtgtggttacaaaagcgattgaaatct

SEQ ID NO: 10704 - protein, 163 aa, Streptococcus agalactiae
MIIRPVLPSDAKELLAIYAPYVADTTITFEYDIPSISEFTNRIKNISKSFPYLVAEENGKILGYAYASTYYARAAYDWTCELSIYLDKDARSKKIGSQLYDTLEKELVNQGYVNLLACISLPNDISIAFHKKRGFNQVAHFPKIGFKFEQWHDIVWLQKRLKS

SEQ ID NO: 10705 - DNA, 183 bp, Streptococcus agalactiae
atgacagagcgagagcttaagaaaattgctaagaagcaaggttttagtaaaactaactttggcaaagggtcacacgaagtttggaaacatccagacggacggacagtgacgatacctaagccaaaggaaaaagattacagaccaggcacactgaacaacattctcaaagtcttgtatggggag

SEQ ID NO: 10706 - protein, 61 aa, Streptococcus agalactiae
MTERELKKIAKKQGFSKTNFGKGSHEVWKHPDGRTVTIPKPKEKDYRPGTLNNILKVLYGE

SEQ ID NO: 10707 - DNA, 96 bp, Streptococcus agalactiae
gtgtttaccgtccataaggacagagtagagcgtttccgtttcagtcgtgttaaaggttcggctgtccataatatcgctggtaaaggagaaatcacc

SEQ ID NO: 10708 - protein, 32 aa, Streptococcus agalactiae
MFTVHKDRVERFRFSRVKGSAVHNIAGKGEIT

SEQ ID NO: 10709 - DNA, 108 bp, Streptococcus agalactiae
atgacatttggtctagtttcaaccaatacatcacacttaaaagatgatgttttcacaccgtcaatggtaagttcattgatttttgtcatgccattcctcctctcaaat

SEQ ID NO: 10710 - protein, 36 aa, Streptococcus agalactiae
MTFGLVSTNTSHLKDDVFTPSMVSSLIFVMPFLLSN

SEQ ID NO: 10711 - DNA, 210 bp, Streptococcus agalactiae
ttgaccccgttggacactgcatttttcgccccatctattgcattggaaatagtggattttatggaattccaaatattgcttgctgttgaaagtatcccattaaaaattcctgaaatcgtgctactcaaattattaaacaaatttgacccagttgagaccagtccagaccacaaattggaaagagtggaagtgaaacttgaccacagagac

SEQ ID NO: 10712 - protein, 70 aa, Streptococcus agalactiae
MTPLDTAFFAPSIALEIVDFMEFQILLAVESIPLKIPEIVLLKLLNKFDPVETSPDHKLERVEVKLDHRD

SEQ ID NO: 10713 - DNA, 345 bp, Streptococcus agalactiae
atggccaagaaatttttcactagacaagatattcaatctatccttgaaacaaaccctttgaaggctaaggtcttctacatggaacgtgaggagaaatcttctcctgacaatgtcatcttgtattatcggttaacaccaggcagtagcattactgctgatgatagagtgcacatgagaaaagtgactttgcaagttagtcactaccacaagaagaaactagacaacattgaaaatttgatgctgtctaattttatgtgtgagccaaatcaattgaatctaaaacaacctgacactgactatctactgacaacttacagacttgaggtgtttacaaatgggcggtgg

SEQ ID NO: 10714 - protein, 115 aa, Streptococcus agalactiae
MAKKFFTRQDIQSILETNPLKAKVFYMEREEKSSPDNVILYYRLTPGSSITADDRVHMRKVTLQVSHYHKKKLDNIENLMLSNFMCEPNQLNLKQPDTDYLLTTYRLEVFTNGRW

SEQ ID NO: 10715 - DNA, 132 bp, Streptococcus agalactiae
ttgctaggattttccgtccaaacaatcggaaatctacaagaacctatcttcaaagaagtatctcctactggcgtaggaactccatctatttggataacatctacaataagatttcaactgacacagctcagt

SEQ ID NO: 10716 - protein, 44 aa, Streptococcus agalactiae
MLGFSVQTIGNLQEPIFKEVSPTGVGTPSIWITSTIRFQLTQLS

SEQ ID NO: 10717 - DNA, 153 bp, Streptococcus agalactiae
ttggcgtctgctttctttaggtcaaaccttacttttagtaggtcttttctctatgctcttattctaaaactagatttaaaaaaagtcaagagattagctaactttttagttaataatttaaaaaggagggtagatgaatgggaatcggttcaa

SEQ ID NO: 10718 - protein, 51 aa, Streptococcus agalactiae
MASAFFRSNLTFSRSFLYALILKLDLKKVKRLANFLVNNLKRRVDEWESVQ

SEQ ID NO: 10719 - DNA, 183 bp, Streptococcus agalactiae
atggaaagtgatttttatgctgtaactcatgtagggcgacttgtttttgttcttgctcagacagattcacatcaacccctaagaccttggttattggattgtaaaatcccgaactatgccagtcgctggcatcgaacaggcacaattccactccaaactctttacagagttggtctagtttca

SEQ ID NO: 10720 - protein, 61 aa, Streptococcus agalactiae
MESDFYAVTHVGRLVFVLAQTDSHQPLRPWLLDCKIPNYASRWHRTGTIPLQTLYRVGLVS

SEQ ID NO: 10721 - DNA, 177 bp, Streptococcus agalactiae
atgtcatatatttctagtttaatattgattatactttatttatctaaaaaaagacatcagaaagaggtattgtcacttgaaaatctttatggagaagctaagtttactctctttatcacttatcttgctatcaactttttcgacatcaccagccctaccacaaatgatatcttatta

SEQ ID NO: 10722 - protein, 59 aa, Streptococcus agalactiae
MSYISSLILIILYLSKKRHQKEVLSLENLYGEAKFTLFITYLAINFFDITSPTTNDILL

SEQ ID NO: 10723 - DNA, 102 bp, Streptococcus agalactiae
ttgattttttataatgatgtcttttttatctttaagaattataacctagataaatctttgttatatatgttgccaagttttatagaagaagaactctatagt

SEQ ID NO: 10724 - protein, 34 aa, Streptococcus agalactiae
MIFYNDVFFIFKNYNLDKSLLYMLPSFIEEELYS

SEQ ID NO: 10725 - DNA, 102 bp, Streptococcus agalactiae
atgaaagatgttcctagagtacctcctgggaatattttaattatttcgcaaccggcttcaagtgctgttgttacctctgataaggtcatgcaacctggtaaa

SEQ ID NO: 10726 - protein, 34 aa, Streptococcus agalactiae
MKDVPRVPPGNILIISQPASSAVVTSDKVMQPGK

SEQ ID NO: 10727 - DNA, 123 bp, Streptococcus agalactiae
ttggttactattcctactattaatgatgaagaaaaaatcctgaaccctacactcctcttctggattaatcatatgtttgaaagtaattggctgactatttttgacataaaagattctatctac

SEQ ID NO: 10728 - protein, 41 aa, Streptococcus agalactiae
MVTIPTINDEEKILNPTLLFWINHMFESNWLTIFDIKDSIY

SEQ ID NO: 10729 - DNA, 453 bp, Streptococcus agalactiae
atgcctaaattaaccctagtctatatcagtcttagcggcaatactcaaagctttgtcaaacgtcttagtgaacaactgtcaacttggcataactgtcaggtttcgactattaatatcaaggaacaaaatcatcaaacctttcctgttgaccaacctttcgtagcactattacccacttaccttgagggaggaaatggcattgacaatggcgatcaagaaattcttaccattccacttggtgattttatagctgcacacaataatgtcaaaaattgtatcggaattgttggctctggaaatagaaattttaacaatcagtactgtttaactgcaaaacaatactctgaacggtttggatttcctatgttaggagactttgaattgcgaggaacttctagcgacgttgaacgtatcgcaaatattatcgttgaaacattatcgaactttaaagcc

SEQ ID NO: 10730 - protein, 151 aa, Streptococcus agalactiae
MPKLTLVYISLSGNTQSFVKRLSEQLSTWHNCQVSTINIKEQNHQTFPVDQPFVALLPTYLEGGNGIDNGDQEILTIPLGDFIAAHNNVKNCIGIVGSGNRNFNNQYCLTAKQYSERFGFPMLGDFELRGTSSDVERIANIIVETLSNFKA

SEQ ID NO: 10731 - DNA, 288 bp, Streptococcus agalactiae
atgatagattatagccaccatattgaagtttctttagagacagatgaacctaagatagccatgtcttattttacattaaaccataagcaaatttttatcatagaaaattcgatagtcgaggaaagaatagatgcttcacgtttgtttggttatggagcaagtagcaagggagaagatagagggttaggcctttataatgtcatgaaagttattgaccgttatcccaatgcatctattagtacaaatagtgaacaacatactttccgtcagggcttagaaataatcttt

SEQ ID NO: 10732 - protein, 96 aa, Streptococcus agalactiae
MIDYSHHIEVSLETDEPKIAMSYFTLNHKQIFIIENSIVEERIDASRLFGYGASSKGEDRGLGLYNVMKVIDRYPNASISTNSEQHTFRQGLEIIF

SEQ ID NO: 10733 - DNA, 144 bp, Streptococcus agalactiae
ttgatggatttgctaaaatgtggatatacattggatgatatagaaacagccagaccagaggatatggaacgttattatgcccctgaacaaatcagaaaatatggagctttaggaatagaattgaggttattgcatggatatttt

SEQ ID NO: 10734 - protein, 48 aa, Streptococcus agalactiae
MMDLLKCGYTLDDIETARPEDMERYYAPEQIRKYGALGIELRLLHGYF

SEQ ID NO: 10735 - DNA, 381 bp, Streptococcus agalactiae
atgttatctggatacaaatttaaaaaagtcaggagaagagtttctaagcgtagcacacaagttttctttgattttacagaagtagaagttactaaatttattgtcttatctcatttagtggataagacaaagaatttagatgactctattaaagaagtctggggcgactcaaaagctcagtccgaacgagatataaaaaatgaattgaaaatgctatcagaggatttctataaattcttatttgaagcagaagatagtatgtttcagttaaaaaaaaataatcagtctttacagaaacaggttaaggagctgacagagcgattaaacattttagaaaatgagaaggattcaggtatatttaacaaacttaagcgaggtttc

SEQ ID NO: 10736 - protein, 127 aa, Streptococcus agalactiae
MLSGYKFKKVRRRVSKRSTQVFFDFTEVEVTKFIVLSHLVDKTKNLDDSIKEVWGDSKAQSERDIKNELKMLSEDFYKFLFEAEDSMFQLKKNNQSLQKQVKELTERLNILENEKDSGIFNKLKRGF

SEQ ID NO: 10737 - DNA, 108 bp, Streptococcus agalactiae
atgagctttgcaaaagttctaactaagaaaaataaattagacaatgtaaacgatttatggtattttgtaagaaattcaaaaaatagatgggttgctggttcagcccat

SEQ ID NO: 10738 - protein, 36 aa, Streptococcus agalactiae
MSFAKVLTKKNKLDNVNDLWYFVRNSKNRWVAGSAH

SEQ ID NO: 10739 - DNA, 204 bp, Streptococcus agalactiae
atgaatacagaaataccaaatcaattattaccattcctagttccgttgattatgttgcaaggagctttaattatcatttctctagtcaaactaagtaaacttaagatgactaaacacctttcaaagccagtttggtttttggtcattatatttcttaatataattgggccaattgcatttcttattttggaagggaataatgaa

SEQ ID NO: 10740 - protein, 68 aa, Streptococcus agalactiae
MNTEIPNQLLPFLVPLIMLQGALIIISLVKLSKLKMTKHLSKPVWFLVIIFLNIIGPIAFLILEGNNE

SEQ ID NO: 10741 - DNA, 144 bp, Streptococcus agalactiae
atgaattataaaagagcctttcttaagggctcttttataattcattatttttcaatgacaaatattagtgaagttaatttttatttaaccattgttattattaatgctgttttgccacttattaatcaacgaaaaagtttcttc

SEQ ID NO: 10742 - protein, 48 aa, Streptococcus agalactiae
MNYKRAFLKGSFIIHYFSMTNISEVNFYLTIVIINAVLPLINQRKSFF

SEQ ID NO: 10743 - DNA, 300 bp, Streptococcus agalactiae
atgactaaaaagataactgttgtagcattagaaacattgattgcccagcataataatatccatttgatagacgttcgtgaagagcatgagtatcgtggggggcatatttcaggtgcgataaatcttcctttgagtcaactcagtcataagtttgaacagttagataaaaataaggaatattatcttgtttgtcaacgagggggaagatctattagagcatgccaatttcttgagttgaaaggctacaaagtaatcaatgtagatggcggcacagaagcgtggagaggaaatctagaagtg

SEQ ID NO: 10744 - protein, 100 aa, Streptococcus agalactiae
MTKKITVVALETLIAQHNNIHLIDVREEHEYRGGHISGAINLPLSQLSHKFEQLDKNKEYYLVCQRGGRSIRACQFLELKGYKVINVDGGTEAWRGNLEV

SEQ ID NO: 10745 - DNA, 765 bp, Streptococcus agalactiae
atgaacgttaaacatatgatgtatctatctggaactctagtggctggtgcattgttattttcaccagctgtattagaagtacatgctgatcaagtgacaactccacaagtggtaaatcatgtaaacagtaataatcaagcccagcaaatggctcaaaagcttgatcaagatagcattcagttgagaaatatcaaagataatgttcagggaacagattatgaaaaaacggttaatgaggctattactagtgttgaaaaattaaagacttcattgcgtgccaaccctgagacagtttatgatttgaattctattggtagtcgtgtagaagccttaacagatgtgattgaagcaatcactttttcaactcaacatttagcaaataaggttagtcaagcaaatattgatatgggatttgggataactaagctggttattcgcattttagatccatttgcttcagttgattcaattaaagctcaagttaacgatgtaaaggcattagaacaaaaggttttaacttatcctgatttaaaaccaactgatagagctacaatctatacaaaatcaaaacttgataaggaaatctggaatacacgctttactagagataaaaaagtacttaacgtcaaagaatttaaagtttacaatactttaaataaagcaatcacacatgctgttggagttcagttgaatccaaatgttacggtacaacaagttgatcaagagattgtaacattacaagcagcacttcaaacagcattaaaa

SEQ ID NO: 10746 - protein, 255 aa, Streptococcus agalactiae
MNVKHMMYLSGTLVAGALLFSPAVLEVHADQVTTPQVVNHVNSNNQAQQMAQKLDQDSIQLRNIKDNVQGTDYEKTVNEAITSVEKLKTSLRANPETVYDLNSIGSRVEALTDVIEAITFSTQHLANKVSQANIDMGFGITKLVIRILDPFASVDSIKAQVNDVKALEQKVLTYPDLKPTDRATIYTKSKLDKEIWNTRFTRDKKVLNVKEFKVYNTLNKAITHAVGVQLNPNVTVQQVDQEIVTLQAALQTALK

SEQ ID NO: 10747 - DNA, 186 bp, Streptococcus agalactiae
atggtttttgggcataatggaacgattttatctaaaatagtacgcttcttattaaatttattttttaagaaaaacattaggctaatctatttgataaaaatagtgataagtagaaattttctaaaatatttagatttatataaggtggtaaattatcgttatggttttttacatgaaaatataaat

SEQ ID NO: 10748 - protein, 62 aa, Streptococcus agalactiae
MVFGHNGTILSKIVRFLLNLFFKKNIRLIYLIKIVISRNFLKYLDLYKVVNYRYGFLHENIN

SEQ ID NO: 10749 - DNA, 321 bp, Streptococcus agalactiae
atgataaatagtaccgtttttcttgctattcttttaggttttgttgtttcttgggtgccaagagtcgctccattcatatttgtaaaatacaaagggctaccaaatagtcttgtgaaatttttaaaatttcttcctctttctattttatttgccctaacattctctagctttttttcagttaaattaggacaattgccaacactaaaatggttagatttattggctggcataccaactctagttgtcactattcgatatcgaaatttattttacactgttcttactggtatcgttactatggctttattgagattactattt

SEQ ID NO: 10750 - protein, 107 aa, Streptococcus agalactiae
MINSTVFLAILLGFVVSWVPRVAPFIFVKYKGLPNSLVKFLKFLPLSILFALTFSSFFSVKLGQLPTLKWLDLLAGIPTLVVTIRYRNLFYTVLTGIVTMALLRLLF

SEQ ID NO: 10751 - DNA, 99 bp, Streptococcus agalactiae
atgctaaaaaaacagtacgagctgactgatttagctaaaaatagaaaaatcccaaaagttaaacttttgggattttatacgcgtaaatatcactatttc

SEQ ID NO: 10752 - protein, 33 aa, Streptococcus agalactiae
MLKKQYELTDLAKNRKIPKVKLLGFYTRKYHYF

SEQ ID NO: 10753 - DNA, 111 bp, Streptococcus agalactiae
gtggggagagaacctgctgttgagggtattttcaccttttttattgctatttttcgtgttataataagaagactatacttttttgacatggagaagtgcgatgacattcta

SEQ ID NO: 10754 - protein, 37 aa, Streptococcus agalactiae
MGREPAVEGIFTFFIAIFRVIIRRLYFFDMEKCDDIL

SEQ ID NO: 10755 - DNA, 120 bp, Streptococcus agalactiae
atgtcagatactcagctaacactagaagaacaagaatttctcaaacaatatatgtctagaaaataccactactttagggatattattcgttacggtcaagtgttggctaaattgactaaa

SEQ ID NO: 10756 - protein, 40 aa, Streptococcus agalactiae
MSDTQLTLEEQEFLKQYMSRKYHYFRDIIRYGQVLAKLTK

SEQ ID NO: 10757 - DNA, 330 bp, Streptococcus agalactiae
gtgagggctgaaattatcgctgtaggaacagaaattttaacaggacagatcgttaatacaaacgcacaatttttgtcggagaaaatggcagaattgggaattgatatttatttccagacagctgtaggagacaatgaggaacgtttattatcgcttttagatatagctagtcagcgcagtcaattggttatcctatgtggtggacttggccctacagaggatgacttaacgaagcaaacttttgctaaatttttaggtaaatcattaacagtagatttattagctagtcgaaaattggatcgttttttttgcaagtcgtcctcagtttgc

SEQ ID NO: 10758 - protein, 110 aa, Streptococcus agalactiae
MRAEIIAVGTEILTGQIVNTNAQFLSEKMAELGIDIYFQTAVGDNEERLLSLLDIASQRSQLVILCGGLGPTEDDLTKQTFAKFLGKSLTVDLLASRKLDRFFCKSSSVC

SEQ ID NO: 10759 - DNA, 246 bp, Streptococcus agalactiae
atggcaacattaaaaacagaacatgattttgacttaacccgtaactggtaccgcaaatccgtctttctagatgagctctggcatggcatgaccgttgcaacacttaatagttacattcgtcagatgaaagacagcccttacgctttcggtatcaaaggaacacacggcaatgtctttatccactcagaagtctttgtggcgtggtttgactacaaaattgccaatcagtatgtcgcaaagatggcg

SEQ ID NO: 10760 - protein, 82 aa, Streptococcus agalactiae
MATLKTEHDFDLTRNWYRKSVFLDELWHGMTVATLNSYIRQMKDSPYAFGIKGTHGNVFIHSEVFVAWFDYKIANQYVAKMA

SEQ ID NO: 10761 - DNA, 96 bp, Streptococcus agalactiae
ttggtttcttcaaacgatgaagacggttcgccaccccaccgctgggcgagtggtcaatacggtagcccagagcaggtggggaaggtggcaaacggc

SEQ ID NO: 10762 - protein, 32 aa, Streptococcus agalactiae
MVSSNDEDGSPPHRWASGQYGSPEQVGKVANG

SEQ ID NO: 10763 - DNA, 213 bp, Streptococcus agalactiae
atgaatcaaacaagtattgaactacaaatggtggagtgggttgcctactcgccagagacacaagagaaagttttcatcaaaccagaggactgcaaagatttagatgacagagaactctatcaccttatcaagagtacgggatttgaacgattgattgaatctagagccttgcagattgtgaccgactttctcaatcagaaaacacaggtaagc

SEQ ID NO: 10764 - protein, 71 aa, Streptococcus agalactiae
MNQTSIELQMVEWVAYSPETQEKVFIKPEDCKDLDDRELYHLIKSTGFERLIESRALQIVTDFLNQKTQVS

SEQ ID NO: 10765 - DNA, 171 bp, Streptococcus agalactiae
atgaaggttatctttcaacagataatgctcaaaggaatagaacctactattgtcctcaacttctttcaatcgttcaataaggtatctcttaatgaagtaatgttcacctctgcttcacttatttcttttttagtgaagcaaaagtcatctttacttctcttatctatttct

SEQ ID NO: 10766 - protein, 57 aa, Streptococcus agalactiae
MKVIFQQIMLKGIEPTIVLNFFQSFNKVSLNEVMFTSASLISFLVKQKSSLLLLSIS

SEQ ID NO: 10767 - DNA, 168 bp, Streptococcus agalactiae
ttggataagagtgtggtcgctttattagtgattcacccaaactggcataacttacttggattagttatccacggaagtgaatcgggagaaatttctttaggggcagaatatatctctactctttcaatactaactgttagtgaattttcttcatctgacctgtctgct

SEQ ID NO: 10768 - protein, 56 aa, Streptococcus agalactiae
MDKSVVALLVIHPNWHNLLGLVIHGSESGEISLGAEYISTLSILTVSEFSSSDLSA

SEQ ID NO: 10769 - DNA, 483 bp, Streptococcus agalactiae
atgaataaaaaagaaacaagacaccaattaattcgttccttagtctctgagactaaggtgcgtacacaacatgagttaagggaattactagaaaaaaatggcgtttcagtgacgcaagcaacattatctcgagatatgaaggaacttaatttaattaaggttaacgaaagcagtgataatgctacagaaacttattatgagattcatagtatatctcagaagcgttgggaagaacggttacgtttttacatggaagatgccctagtcatgctgtttccagttcaaaaccaaatcgttttgaagacactacctggcttagctcaatcttttggctccatattagattcgattttattacctgagatcttagcaactgtctgtggtgatgatacttgtttgattatttgtaataatagtgaagaagctcaaaagtgttttgagaaattaagtcagtatacgccgcctttcttcttctcaaaaaaa

SEQ ID NO: 10770 - protein, 161 aa, Streptococcus agalactiae
MNKKETRHQLIRSLVSETKVRTQHELRELLEKNGVSVTQATLSRDMKELNLIKVNESSDNATETYYEIHSISQKRWEERLRFYMEDALVMLFPVQNQIVLKTLPGLAQSFGSILDSILLPEILATVCGDDTCLIICNNSEEAQKCFEKLSQYTPPFFFSKK

SEQ ID NO: 10771 - DNA, 690 bp, Streptococcus agalactiae
atgcgcagagatgatattataatgccacaagatggaagaaaaatggctgtattattgggttttattggtggttttattgacgtttatagtcacatgcagtttcactcccttgttgcaacacagacaggtaatattatcttgatggtggcaaatctcggacaaaatgattttcacttttttatcactaaattattttctattttctttttttcaattggttttttggttggtattgtgattaaagaacgtgcagtaacagctttttggcgtctatatgcattatgtccccttttactttctacgatgtttattccttttgttgaaaatgtaaaccacaatatctgggtagctttattagcctttagcacaggtattttaatgttgacattttcaggaagtcgcattgaatcggaaccatatactatcttaatgacttctggtaattatcggaaaatgctacaattttggtatgagtatattgttaatcgtcagagaacggctatgcaaaaaagacgagctatcaattattcactggtagttctagcatttattattggagcattggtagctgcaatagtttacgatatttttgcatatagagctattttaggtgtgacgataacgcttttaattattatgattcattatacgattgaaattattaagaacgatttaacgttacataatgtt

SEQ ID NO: 10772 - protein, 230 aa, Streptococcus agalactiae
MRRDDIIMPQDGRKMAVLLGFIGGFIDVYSHMQFHSLVATQTGNIILMVANLGQNDFHFFITKLFSIFFFSIGFLVGIVIKERAVTAFWRLYALCPLLLSTMFIPFVENVNHNIWVALLAFSTGILMLTFSGSRIESEPYTILMTSGNYRKMLQFWYEYIVNRQRTAMQKRRAINYSLVVLAFIIGALVAAIVYDIFAYRAILGVTITLLIIMIHYTIEIIKNDLTLHNV

SEQ ID NO: 10773 - DNA, 702 bp, Streptococcus agalactiae
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggat

SEQ ID NO: 10774 - protein, 234 aa, Streptococcus agalactiae
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNGKGNKLPATGENATPFFNVVALTIMSSVGLLSVSKKKED

SEQ ID NO: 10775 - DNA, 1830 bp, Streptococcus agalactiae
atgaatattgaagatttgaagaaacgtcaagaaaagattagaaacttttcgattatcgctcatattgaccatggaaaatcaaccttagcagaccgtattttagagaaaacagaaacggtttctagtcgtgaaatgcaggcgcaactgttggactctatggatctagaacgtgagcgtggaattactataaagttaaatgctattgagcttaattatactgctaaagatggtgaaacttacatttttcacttgattgacacgccagggcatgttgacttcacatatgaagtatcacgttcattggcagcttgtgagggtgctatactggttgttgatgcagcccaaggaattgaagctcaaactctggcaaatgtttatttggctctagacaatgatttagagatactaccagttattaataaaattgatttaccagcagcagatccagaacgtgtacgtgcagaagtagaggatgttattggtctagatgcttcagaagctgtgcttgcctcagctaaggcagggattggtattgaagaaattttagagcagatcgttgaaaaagttcctgcaccgactggggaagtagatgctcctcttcaagctctaatttttgattctgtttatgatgcttatcgtggagtaattcttcaagtaaggattgtaaatggtatggttaagccaggagataagattcaaatgatgtctaatggtaaaaccttcgacgttactgaggttggtattttcactcccaaagcagttggacgtgattttttagcaactggagatgtagggtatattgctgcctcaattaaaacggttgctgatacacgtgttggtgataccattacccttgctaataacccagcaatagaacccttgcatggctataagcaaatgaacccaatggtttttgccggtctttatccaattgaatcaaataagtataacgatctgcgtgaagcccttgaaaaattacaattgaatgatgctagtctacagtttgaaccggaaacatcacaagcattagggtttggtttccgttgtggtttcttaggacttttacatatggacgttatccaagagcgcttggaacgagagttcaatattgatcttattatgactgcaccatcagtagtttatcatgttaatacaactgacggtgaaatgcttgaagtttcgaatccatctgaatttcctgatcctactcgtgttgacagcattgaagaaccatatgttaaggcgcaaattatggttcctcaagaatttgtcggtgctgtaatggagttagcacaacgtaaacgtggtgactttgtaacaatggattatattgatgataatcgtgttaatgttatttaccaaattcctttagctgaaattgtgtttgacttctttgataagcttaaatcatcaacacgtggctatgctagttttgattatgaaatttccgaatatcgtcgctcacaattagttaaaatggatattcttttaaatggtgataaagtggatgctttaagctttattgttcacaaagaatttgcctatgaacgtggtaaattgatcgttgataagttgaaaaaaatcattcctcgtcagcagtttgaagttcctatccaagcagctattggacaaaaaattgtggcccgttctgatataaaagcactacgtaaaaatgtcttagcaaaatgttatggtggtgacgtttcacgtaaacgtaagttgcttgaaaaacaaaaagctggtaaaaagcgcatgaaagcaattggttccgtcgaagttcctcaggaagctttcttaagtgttttatcaatggacgatgatgacaaaaaa

SEQ ID NO: 10776 - protein, 610 aa, Streptococcus agalactiae
MNIEDLKKRQEKIRNFSIIAHIDHGKSTLADRILEKTETVSSREMQAQLLDSMDLERERGITIKLNAIELNYTAKDGETYIFHLIDTPGHVDFTYEVSRSLAACEGAILVVDAAQGIEAQTLANVYLALDNDLEILPVINKIDLPAADPERVRAEVEDVIGLDASEAVLASAKAGIGIEEILEQIVEKVPAPTGEVDAPLQALIFDSVYDAYRGVILQVRIVNGMVKPGDKIQMMSNGKTFDVTEVGIFTPKAVGRDFLATGDVGYIAASIKTVADTRVGDTITLANNPAIEPLHGYKQMNPMVFAGLYPIESNKYNDLREALEKLQLNDASLQFEPETSQALGFGFRCGFLGLLHMDVIQERLEREFNIDLIMTAPSVVYHVNTTDGEMLEVSNPSEFPDPTRVDSIEEPYVKAQIMVPQEFVGAVMELAQRKRGDFVTMDYIDDNRVNVIYQIPLAEIVFDFFDKLKSSTRGYASFDYEISEYRRSQLVKMDILLNGDKVDALSFIVHKEFAYERGKLIVDKLKKIIPRQQFEVPIQAAIGQKIVARSDIKALRKNVLAKCYGGDVSRKRKLLEKQKAGKKRMKAIGSVEVPQEAFLSVLSMDDDDKK

SEQ ID NO: 10777 - DNA, 762 bp, Streptococcus agalactiae
ttggacgctaaatttgatttcgctaaacaattagtgtataaagctggtcaattcattaaatctgagatgcaaaatacttttgatgttgaggaaaagtctcgatttgatgatttagtgacaagtcttgataaaaaaacacaaaaattattaattcaagaaattattcaacattacccagatgataatatacttgccgaagaagatgatgtgcgctcacccattgcacaaggtaatgtttgggttttagaccctattgatggaactgttaattttattgttcaaaaagataactttgctgttatgttagcttattacgaagaaggcgttggacaatttggtatcatctacgacgttatggctgatattctttacagcgggggaggacattttgatgtctatgctaacgataaaaaaattgttccttttcaagagtgtcctttagaacgttgcttacttggagtaaattctgctatgtatgcagaaaatgattgcggtattgcccatttagcttctgaaaccttaggtgttcgtatctatggtggtgctggaattagcatggcaaaagtcatgcagggcaaattattagcttatttttcgtatattcaaccttgggattatgctgcagcaaaaatcatgggggagacattaggatttaccttattaacgcttgacggggaagaacccaactattcaacaagacaaaaagtaatgttcctaccaaagtcgaaattaaatcttatccaatcctaccttaccaaaaaa

SEQ ID NO: 10778 - protein, 254 aa, Streptococcus agalactiae
MDAKFDFAKQLVYKAGQFIKSEMQNTFDVEEKSRFDDLVTSLDKKTQKLLIQEIIQHYPDDNILAEEDDVRSPIAQGNVWVLDPIDGTVNFIVQKDNFAVMLAYYEEGVGQFGIIYDVMADILYSGGGHFDVYANDKKIVPFQECPLERCLLGVNSAMYAENDCGIAHLASETLGVRIYGGAGISMAKVMQGKLLAYFSYIQPWDYAAAKIMGETLGFTLLTLDGEEPNYSTRQKVMFLPKSKLNLIQSYLTKK

SEQ ID NO: 10779 - DNA, 1371 bp, Streptococcus agalactiae
ttgggaatactgattgtatttccttttttattggttttattgttgactgcttcgtcaagttctcaacaagattgtcaaattacaccagatgtatcttcacaagttgaaacctcaagtgagaatgcttccaatagtgattggacaaaaaagggaacagttgcaaatcaaacagcagagaaggtattcaatgcttgggtaagtaaaggcttatctggtgcgagtgcatcagggattgttggttgggttaattcagaaggtggatttgctatgataggtcgagcagaagggcattatggtaatgatttaaaaacaaattcaattgcctttaatgtgagacctactgggttatcttactatacgactgaagctggaggtggtatttatcaaatcacacctttcacaaagtatgccccattaggcgatcccaaatgggaagatgcagatgccatgaatgcctttgttatgaaatccattaaatcaggagactggaataaagcaatggatttatcaggtggaaatcattcttttgaagagatggcacagatgactgatcccaagcaggccactttagtttggaatgcttacgaacgaggaaatactgcatatattaataaagctcaaaagactgcggatgggcaaaaagcctatgaaatatttaatggttcaaaatataaatttgatgcagaaaaattttctaaaagttttggtggtggttcaaaaacgtcctcgtctggtaagagcgatataatttctgattctacagttttatctctttgtgattcagctagtaatgcggtacagggcttatttggtaaagataagtcagggaaagttaaatacacttcttataatgcatggaaaccagatcaattaccaagtgatttgaaaaagtatgcaatagatcctaagtcagttggtttattttatcgaacgtctagtggatggaatgcgatagcttctactggtggtcaatgtacagatctttcagcaagtttgatgtatggtttatggcttaaaggcggaatgcatccaacgcaaagaatgggaaatggtaatatggttgtttctaattgggtatctgcattcggtggacgctctgaaaatactccatcttctggagctgttttttcaagttcaggtacttctagtgctgggcatactggagtggttagtcatgtatttgaaaatggcgatatgttaatagtagagcaaaattattcaacttattctggagataatagaggatttggaccatattcatggaattatcgttatgtttctactttagaattaaaaaaagagcattatagtttttataatccctctaaagctggttataaattgtctgataaagtgaaaacggtaggtagt

SEQ ID NO: 10780 - protein, 457 aa, Streptococcus agalactiae
MGILIVFPFLLVLLLTASSSSQQDCQITPDVSSQVETSSENASNSDWTKKGTVANQTAEKVFNAWVSKGLSGASASGIVGWVNSEGGFAMIGRAEGHYGNDLKTNSIAFNVRPTGLSYYTTEAGGGIYQITPFTKYAPLGDPKWEDADAMNAFVMKSIKSGDWNKAMDLSGGNHSFEEMAQMTDPKQATLVWNAYERGNTAYINKAQKTADGQKAYEIFNGSKYKFDAEKFSKSFGGGSKTSSSGKSDIISDSTVLSLCDSASNAVQGLFGKDKSGKVKYTSYNAWKPDQLPSDLKKYAIDPKSVGLFYRTSSGWNAIASTGGQCTDLSASLMYGLWLKGGMHPTQRMGNGNMVVSNWVSAFGGRSENTPSSGAVFSSSGTSSAGHTGVVSHVFENGDMLIVEQNYSTYSGDNRGFGPYSWNYRYVSTLELKKEHYSFYNPSKAGYKLSDKVKTVGS

SEQ ID NO: 10781 - DNA, 927 bp, Streptococcus agalactiae
atgaaaacaagatcaaaacttgcagcaggctttttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagataaaaatggtgtttcagatgtggtttcaacggttgattcaacaacttataaaacaagttactacatcattaaagtaactgataagacagagaaaaaatctgattggaaatcttacaaaaatcgcttaaaagaagttattcttaaggataaaacaagcgatagagccttccaaaataaagtgatttcaaaagccttagaaaaagctaatgttaagattaaagataaagcatttgcaggcatcttatcacaatatgctacaacaagtggttcatcatcacttaaaaaa

SEQ ID NO: 10782 - protein, 309 aa, Streptococcus agalactiae
MKTRSKLAAGFLTLMSVATLAACSGKTSNGTNVVTMKGDTITVSDFYDQVKTSKAAQQSMLTLILSRVFDTQYGDKVSDKKVSEAYNKTAKGYGNSFSSALSQAGLTPEGYKQQIRTTMLVEYAVKEAAKKELTEANYKEAYKNYTPETSVQVIKLDAEDKAKSVLKDVKADGADFAKIAKEKTTATDKKVEYKFDSAGTTLPKEVMSAAFKLDKNGVSDVVSTVDSTTYKTSYYIIKVTDKTEKKSDWKSYKNRLKEVILKDKTSDRAFQNKVISKALEKANVKIKDKAFAGILSQYATTSGSSSLKK

SEQ ID NO: 10783 - DNA, 813 bp, Streptococcus agalactiae; identical to SEQ ID NO: 843

SEQ ID NO: 10784 - protein, 271 aa, Streptococcus agalactiae
LKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDNRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPFIILVTSFNFASGVVLYWTVSNAFQVFQILLLNNPYKIIKVREEAVRVAHEKEQRVKRAKRKASKKRK

SEQ ID NO: 10785 - DNA, 690 bp, Streptococcus agalactiae
atgaataaaatagctaatacagaagttgaaataaatatattcaaccttttaaaaaaattgtggaaaaagaaatttttaatcacatttgttgccattgcatttgcaacagctggacttttctatagtctttttattgttacgccacaatatacttcttcaacaaggatatatgtcattaaccctaatacccctaataatagtattactgcacaagatctacaagcggggagttttcttgcaaatgactataaggagattattacgtctactgacgttctagaaaaagttatttcttctgaaaaattgaattatccttcgtctcagttgttgcaaaaaataacagtttctattttaaaagatacacgtgttatttcaatatcggtcgaagatgctaatccaaaaatgtctcaaaaattagcaaattcagttagagaagcagcagtttcaaaaatcaaggcagttactcaagtagaggatatcactactcttgagaagggaaatttacctaaagcaccatcttctcctaatattaaaaagaatgtactaatcgggtttattgttggtgcaggattatcaactattgttttagttattatgggtattttggatgatcgtgttaatactgaagaagatattgaaaaggtsctaggacttacttctttaggtatagtaccagatttgaataaactt

SEQ ID NO: 10786 - protein, 230 aa, Streptococcus agalactiae; identical to SEQ ID NO: 2768

SEQ ID NO: 10787 - DNA, 669 bp, Streptococcus agalactiae
atgactttacaagacttaactaaaaagaatcaagagtttgttcatattgcaactaatcaacttttagctgatggaaaatcagatgcagaaatcaaagctattttagaagaacatctcccagagattatagataatcagaaaaaaggaattaccgcacgctcactcttaggagcaccaactacttgggcagcctcattcactgagcgacctgaggataaagctagagtatctgtacaaaaaaataccaatccttggttgatgtggttagatacttccttactatttcttggcttagtaactgctttgaatggtttaatgttgctatttggtcaatctaatgtcaatacagggcttatttcaattttaactcttggttttggtggtggtgcggccatgtacgttacttattactatatttatcgccatatgggtaaaccaaaatctgaaagaccaggctggcttaaatctttcgcagtactggcactagttatgttagtttggtttgccttatttgcagtagtacctcttctacctgcaactattaatcctaaacttcctgaggttgttttgtttattattgctttagcatcgtttggtttgcgcttttatttacaacgtaaatataatattcaaagctcaatggcaccagtggcaccmcaacaaagaaga

SEQ ID NO: 10788 - protein, 223 aa, Streptococcus agalactiae; identical to SEQ ID NO: 3552

SEQ ID NO: 10789 - DNA, 540 bp, Streptococcus agalactiae
atgtcaaaaaaaacmacacaaatggtttcttatacttctattttagtagcttttgcaatcatgattcctataatcatgcctgctaaaataattattgggcctgcttctttcaccttagcaagccatgtacctttatttttaagtatttttatatctgttccagttgcaatattggtagctttagggacaggacttggatttctactagctggttttccgattgtaatcgttcttagagctttatcacatatcggatttgcattaattgcggctttcttgattaagtcaaagccctctttattgatgagtaaatggcaaacattgttatttgctgtagctattaacataattcatggtctgctcgaatttattactgtttatataatcacaatgacttctaacagtagttcaacttatttatggtcactattttctttgataggactaggctctttgctacatggattggtagatttttacatagctctcttcatttggaaatggatgacacaaaagttggggaaaacacttaggataaga

SEQ ID NO: 10790 - protein, 180 aa, Streptococcus agalactiae; identical to SEQ ID NO: 8838

SEQ ID NO: 10791 - DNA, 198 bp, Streptococcus agalactiae
gtgggttcgattcctactgcccgtgttttttctaatatggcgggtgtggtgaagtggttaacacatcagattgtggctctgacattcgtgggttcgattcccatcactcgccttttcatggggtatagccaagcggtaaggcaagggactttgactccctcatgcgttggttcgaatccagctaccccagttttaaga

SEQ ID NO: 10792 - protein, 66 aa, Streptococcus agalactiae
MGSIPTARVFSNMAGVVKWLTHQIVALTFVGSIPITRLFMGYSQAVRQGTLTPSCVGSNPATPVLR

SEQ ID NO: 10793 - DNA, 1653 bp, Streptococcus agalactiae
atggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaaa

SEQ ID NO: 10794 - protein, 551 aa, Streptococcus agalactiae
MAKQKNNWRRVGVGVLTLASVATLAACGSKSASQDSNGAINWAIPTEINTLDLSKVTDTYSNLAIGNSSSNFLRLDKDGKTRPDLATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKK

SEQ ID NO: 10795 - DNA, 309 bp, Streptococcus agalactiae
atgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggag

SEQ ID NO: 10796 - protein, 103 aa, Streptococcus agalactiae
MMQEYFGIGLDSSSRCYHYHTKLDIVALKCAVCQKYYACYKCHDALEEHCFAATKSDETFPVLCGSCRQMLTLKEYKTGFCPYCRMLFNPNCQRHDSIYFSKE

SEQ ID NO: 10797 - DNA, 453 bp, Streptococcus agalactiae
ttggcagtcaacgaaccgcccgaagtattttggggatgtaggaggaagggagtcactatctcgcctcctctttttatagcttatttagattggagaacatttatgaacacacgtgtctttaaggacatctcaaaggttcaacacagggcatggctgggatttacaactagacaggttatttttgtatttccagctgtcgccctaaccattttggttttgggcttgaacctattttattggcaatttggggattggtttgtctatggttttgtttttagctttaccattccactcatgttatttggggtctatcgccccaacgatttaccatttgaaatatacctcaagtaccgttttcattatgaactaacggtgccagaccgcacatttactggaagaaaaggagaccaacgtgaaaaaattaaaacactcaatgaaatcaaagacctcttc

SEQ ID NO: 10798 - protein, 151 aa, Streptococcus agalactiae
MAVNEPPEVFWGCRRKGVTISPPLFIAYLDWRTFMNTRVFKDISKVQHRAWLGFTTRQVIFVFPAVALTILVLGLNLFYWQFGDWFVYGFVFSFTIPLMLFGVYRPNDLPFEIYLKYRFHYELTVPDRTFTGRKGDQREKIKTLNEIKDLF

SEQ ID NO: 10799 - DNA, 216 bp, Streptococcus agalactiae
gtgaacgtgaaaatgttacaatatcttgaggaggtgaaacatatgtcaaaaacagtagtacgtaaaaacgaatcacttgacgatgcacttcgtcgtttcaaacgttctgtgactaaagctggtactcttcaagaatcacgtaaacgtgaattctacgaaaaaccttctgtaaaacgtaaacgtaaatcagaagcagctcgcaaacgtaaaaaattc

SEQ ID NO: 10800 - protein, 72 aa, Streptococcus agalactiae
MNVKMLQYLEEVKHMSKTVVRKNESLDDALRRFKRSVTKAGTLQESRKREFYEKPSVKRKRKSEAARKRKKF

SEQ ID NO: 10801 - DNA, 801 bp, Streptococcus agalactiae
atgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 10802 - protein, 267 aa, Streptococcus agalactiae
MGVKKGQRIYHILKTNDLEVSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 10803 - DNA, 123 bp, Streptococcus agalactiae
ttggagctggagacaatgacatttggtctagtttcaaccaatacatcacacttaaaagatgatgttttcacaccgtcaatggtaagttcattgatttttgtcatgccattcctcctctcaaat

SEQ ID NO: 10804 - protein, 41 aa, Streptococcus agalactiae
MELETMTFGLVSTNTSHLKDDVFTPSMVSSLIFVMPFLLSN

SEQ ID NO: 10805 - DNA, 237 bp, Streptococcus agalactiae
ttgccaatttctgtcttcgttctaccatcaggcttgttctcttcactaggtgagggttgcgatggttctgttgtaggtggattagttgacggatttgtttctggttcacttgatgaactcgattcattttcagaagaagaaccagtactagactggtctagttcatctgatcttttctcctcagataaggtcgtagtcacgacactcgtgtcagtattcttatcacttgtatcagca

SEQ ID NO: 10806 - protein, 79 aa, Streptococcus agalactiae
MPISVFVLPSGLFSSLGEGCDGSVVGGLVDGFVSGSLDELDSFSEEEPVLDWSSSSDLFSSDKVVVTTLVSVFLSLVSA

SEQ ID NO: 10807 - DNA, 210 bp, Streptococcus agalactiae
ttgtctatcaatttcttcgcttcttcaatattcatttgctacctccaaaaatacttcactgcattcattgtactcaattctataaccttttttgtcatttacccatttataaacatgattatccttgctattttagtcgctcatacgaaaaacgaatatgctttaaaaaatcttcaatgtcaattactgcacaaccatcaatgtcagacc

SEQ ID NO: 10808 - protein, 70 aa, Streptococcus agalactiae
MSINFFASSIFICYLQKYFTAFIVLNSITFFVIYPFINMIILAILVAHTKNEYALKNLQCQLLHNHQCQT

SEQ ID NO: 10809 - DNA, 171 bp, Streptococcus agalactiae
gtgctgtttcgaatggttccaaaacacaaaatcttttgttgctcctggacgtattgttttagagctgtgctgtttcgaatggttccaaaacatgtaaggtattgtaaaacttcttcttgcggttttagagctgtgctgtttcgaatggttccaaaacactgttcctataat

SEQ ID NO: 10810 - protein, 57 aa, Streptococcus agalactiae
MLFRMVPKHKIFCCSWTYCFRAVLFRMVPKHVRYCKTSSCGFRAVLFRMVPKHCSYN

SEQ ID NO: 10811 - DNA, 165 bp, Streptococcus agalactiae
atgtggataatactctttaaagtgtggataatactatattataaagctttttatctgatttttctgtattttgaaatcaaattatattttttaattttagtttatatttcaaaaattaaaacaccctataaccaagtatcacagggtgcatatttttatattata

SEQ ID NO: 10812 - protein, 55 aa, Streptococcus agalactiae
MWIILFKVWIILYYKAFYLIFLYFEIKLYFLILVYISKIKTPYNQVSQGAYFYII

SEQ ID NO: 10813 - DNA, 135 bp, Streptococcus agalactiae
atggttccaaaactggttatacatttactaatccatcagcattgttttagagctgtgctgtttcgaatggttccaaaacaagctaattctcatctcaccgagatggatagttttagagctgtgctgttattatgc

SEQ ID NO: 10814 - protein, 45 aa, Streptococcus agalactiae
MVPKLVIHLLIHQHCFRAVLFRMVPKQANSHLTEMDSFRAVLLLC

SEQ ID NO: 10815 - DNA, 360 bp, Streptococcus agalactiae
ttgcttaataaaacctatttaacgacagcaacaatgtcactttcgcgaacaactgtcactttttcgttaccgtctttaacttccagaccagcaccattttcgactaaaacagtatcaccctctgcaacgctcggtgcaactaattcccctgttaaggtacgaataccgtcacccacagcaagaactttggctgtctttgtcgcatcatggcttgctcctgcaagaacaaaaccaccgacagatttctcttcagtttcaacaaacgaaatgatcacacgatcacctaatggttttaacataataaacgaacctccatacgagatatattttgattttttagcactcttatacagagagtgc

SEQ ID NO: 10816 - protein, 120 aa, Streptococcus agalactiae
MLNKTYLTTATMSLSRTTVTFSLPSLTSRPAPFSTKTVSPSATLGATNSPVKVRIPSPTARTLAVFVASWLAPARTKPPTDFSSVSTNEMITRSPNGFNIINEPPYEIYFDFLALLYREC

SEQ ID NO: 10817 - DNA, 123 bp, Streptococcus agalactiae
atgaaaattcagaaaattgtagaaaattttgattttttatgttttaatagtttttgtaattattatgttacaagaaaaggagatttttatgaacacaaaacagcgtttttcaatccggaaata

SEQ ID NO: 10818 - protein, 41 aa, Streptococcus agalactiae
MKIQKIVENFDFLCFNSFCNYYVTRKGDFYEHKTAFFNPEI

SEQ ID NO: 10819 - DNA, 141 bp, Streptococcus agalactiae
atgataccgttttctaacttgaaaatcaacacttattttcaaatattttcaatttgtcaagaaatatgcttacaaagactatcaaaagaggttacctgggtaacctcttttactatttcttattttttcttaagttcacct

SEQ ID NO: 10820 - protein, 47 aa, Streptococcus agalactiae
MIPFSNLKINTYFQIFSICQEICLQRLSKEVTWVTSFTISYFFLSSP

SEQ ID NO: 10821 - DNA, 147 bp, Streptococcus agalactiae
atgatctttttaaaagtgataaagatgatttttgtccgataccaactttatagaggcccttttcgcattcaaactttgataggatatttggataataatagtcaaacatatggtcagaaagtaaaagccagtattgattgggataat

SEQ ID NO: 10822 - protein, 49 aa, Streptococcus agalactiae
MIFLKVIKMIFVRYQLYRGPFRIQTLIGYLDNNSQTYGQKVKASIDWDN

SEQ ID NO: 10823 - DNA, 180 bp, Streptococcus agalactiae
ttgtacaacttgtcaaaaccacattcaggacaacgttcaggtggtccgactgcttcaactttaaacatcatatcggtttcattttcttgtggcggttctattgttttaatgtctggtagggataataagtctgacatattattcatcctttattactctgcggtgttaaggtatcaatta

SEQ ID NO: 10824 - protein, 60 aa, Streptococcus agalactiae
MYNLSKPHSGQRSGGPTASTLNIISVSFSCGGSIVLMSGRDNKSDILFILYYSAVLRYQL

SEQ ID NO: 10825 - DNA, 180 bp, Streptococcus agalactiae; identical to SEQ ID NO: 10823

SEQ ID NO: 10826 - protein, 60 aa, Streptococcus agalactiae; identical to SEQ ID NO: 10824

SEQ ID NO: 10827 - DNA, 105 bp, Streptococcus agalactiae
ttgccaaaagctataaaacgattcccaaataatttcttagtggcttttcccttgtcaactgcaatgggatttatgtacaaacatttttcaaattcgtggaaaaag

SEQ ID NO: 10828 - protein, 35 aa, Streptococcus agalactiae
MPKAIKRFPNNFLVAFPLSTAMGFMYKHFSNSWKK

SEQ ID NO: 10829 - DNA, 105 bp, Streptococcus agalactiae
ttgataactgctattgataataatattattgttttggctggggtccaaggttcttgtttgcttaccattaaccgtccaggtatctaccctgtaatctggattatt

SEQ ID NO: 10830 - protein, 35 aa, Streptococcus agalactiae
MITAIDNNIIVLAGVQGSCLLTINRPGIYPVIWII

SEQ ID NO: 10831 - DNA, 168 bp, Streptococcus agalactiae
atggttccaaaacaaggtacttttagcttgttcttgtggtgttgttttagagctgtgctgtttcgaatggttccaaaacacagctactgtaaattctgcttttacggttgttttagagctgtgctgtttcgaatggttccaaaactagtgcagttgtcaaggagattg

SEQ ID NO: 10832 - protein, 56 aa, Streptococcus agalactiae
MVPKQGTFSLFLWCCFRAVLFRMVPKHSYCKFCFYGCFRAVLFRMVPKLVQLSRRL

SEQ ID NO: 10833 - DNA, 93 bp, Streptococcus agalactiae
ttggtagctattcaatacatgaaatccgttaattttttcttctctgtttgcaatcagtatttttataaatctatcattgcaatgctcagatgg

SEQ ID NO: 10834 - protein, 31 aa, Streptococcus agalactiae
MVAIQYMKSVNFFFSVCNQYFYKSIIAMLRW

SEQ ID NO: 10835 - DNA, 108 bp, Streptococcus agalactiae
ttggaccaaccaaaagtcaacaacagcccaactaaagctgtcaaaccagcatttcctaaaacttcaaaggacccccttaatcctaagagttttcttctttctttgcct

SEQ ID NO: 10836 - protein, 36 aa, Streptococcus agalactiae
MDQPKVNNSPTKAVKPAFPKTSKDPLNPKSFLLSLP

SEQ ID NO: 10837 - DNA, 141 bp, Streptococcus agalactiae
atgggcaattcatcaaaatccaacagaaaggaggagctagatttgtctacctttgaggtcttaacactcatgtttatagcaggtaacttcgttatcgctctcgtgaagttagtccttgaactggtaaaatcgacaaaaaaa

SEQ ID NO: 10838 - protein, 47 aa, Streptococcus agalactiae
MGNSSKSNRKEELDLSTFEVLTLMFIAGNFVIALVKLVLELVKSTKK

SEQ ID NO: 10839 - DNA, 171 bp, Streptococcus agalactiae
atgaatagtaatgtttttgtcatccaatccatcaatgcattaccgattgtctggataaagtcaaataaaccagaaaaagttttcgtaatccaattggtcgttgactctacaaatggtgcgaccggtaacttatgttgtaataaattttccaaaatgatttgtcctctctat

SEQ ID NO: 10840 - protein, 57 aa, Streptococcus agalactiae
MNSNVFVIQSINALPIVWIKSNKPEKVFVIQLVVDSTNGATGNLCCNKFSKMICPLY

SEQ ID NO: 10841 - DNA, 189 bp, Streptococcus agalactiae
atgttaggcagaggcgcaaaagcatatctcaacacaacacacaaagcagataatatagcgactctagtcaatttagttaaagttgaattctttatcatgtctttaattatacctcaaaactatgactaccgcttaaaagtcttttttattacaatttcatttctaatgttacataaacgacctcttttt

SEQ ID NO: 10842 - protein, 63 aa, Streptococcus agalactiae
MLGRGAKAYLNTTHKADNIATLVNLVKVEFFIMSLIIPQNYDYRLKVFFITISFLMLHKRPLF

SEQ ID NO: 10843 - DNA, 132 bp, Streptococcus agalactiae
atgatttatacttgttcctatcataataaaaggaagatagtttatgtcaaaaaaaataatattaggaattttatctcttttatctgtcgttactttggtggcgtgtggttcatcagacaaacagctacaaga

SEQ ID NO: 10844 - protein, 44 aa, Streptococcus agalactiae
MIYTCSYHNKRKIVYVKKNNIRNFISFICRYFGGVWFIRQTATR

SEQ ID NO: 10845 - DNA, 249 bp, Streptococcus agalactiae
gtgctgtttcgaatggttccaaaactaattgccaatgcttacaatatcttcgtcagttttagagctgtgctgtttcgaatggttccaaaacatgttctgaattacctttctcgacactccggttttagagctgtgctgtttcgaatggttccaaaacaccatcaaggctcttatctgcagattgttagttttagagctgtgctgtttcgaatggttccaaaacaaatggttgccaatgactttctagag

SEQ ID NO: 10846 - protein, 83 aa, Streptococcus agalactiae
MLFRMVPKLIANAYNIFVSFRAVLFRMVPKHVLNYLSRHSGFRAVLFRMVPKHHQGSYLQIVSFRAVLFRMVPKQMVANDFLE

SEQ ID NO: 10847 - DNA, 213 bp, Streptococcus agalactiae
atggtaagcaaacaagaaccttggaccccagccaaaacaataatattattatcaatagcagttatcaaagggaatcatctaactctagtattacgaaaccaagctatacaatcactatcgggaatcagaaacaaattgtacaaaatgatgacggtaaaatccaacggtcttactttgaggcagaggcaacgtatcaacgaactctacaagaag

SEQ ID NO: 10848 - protein, 71 aa, Streptococcus agalactiae
MVSKQEPWTPAKTIILLSIAVIKGNHLTLVLRNQAIQSLSGIRNKLYKMMTVKSNGLTLRQRQRINELYKK

SEQ ID NO: 10849 - DNA, 132 bp, Streptococcus agalactiae
atgtgcgatcacggacgttttagagctgtgctgtttcgaatggttccaaaacttttaccaatgcttccatatcgcttatatgttttagagctgtgctgtttcgaatggttccaaaactggttatacatttac

SEQ ID NO: 10850 - protein, 44 aa, Streptococcus agalactiae
MCDHGRFRAVLFRMVPKLLPMLPYRLYVLELCCFEWFQNWLYIY

SEQ ID NO: 10851 - DNA, 168 bp, Streptococcus agalactiae
atgtatggtaaaaagaattggtggcaggtgtattcttcatcagtttattttctgaaaaaagagtataatataggtatcaaaaatgaaaacgttttagagaaggagactagaatatggcttctacaaataatgtttcagatacaaacacacgttttgctaaagaggagt

SEQ ID NO: 10852 - protein, 56 aa, Streptococcus agalactiae
MYGKKNWWQVYSSSVYFLKKEYNIGIKNENVLEKETRIWLLQIMFQIQTHVLLKRS

SEQ ID NO: 10853 - DNA, 120 bp, Streptococcus agalactiae
gtggccgatcaccctctcaggtcggctatgtatcgtcgccttggtgagcctttacctcaccaactagctaatacaacgcaggtccatctcacagtgaagcaattgctccttttaaataac

SEQ ID NO: 10854 - protein, 40 aa, Streptococcus agalactiae
MADHPLRSAMYRRLGEPLPHQLANTTQVHLTVKQLLLLNN

SEQ ID NO: 10855 - DNA, 120 bp, Streptococcus agalactiae; identical to SEQ ID NO: 10853

SEQ ID NO: 10856 - protein, 40 aa, Streptococcus agalactiae; identical to SEQ ID NO: 10854

SEQ ID NO: 10857 - DNA, 120 bp, Streptococcus agalactiae; identical to SEQ ID NO: 10853

SEQ ID NO: 10858 - protein, 40 aa, Streptococcus agalactiae; identical to SEQ ID NO: 10854

SEQ ID NO: 10859 - DNA, 120 bp, Streptococcus agalactiae; identical to SEQ ID NO: 10853

SEQ ID NO: 10860 - protein, 40 aa, Streptococcus agalactiae; identical to SEQ ID NO: 10854

SEQ ID NO: 10861 - DNA, 120 bp, Streptococcus agalactiae; identical to SEQ ID NO: 10853

SEQ ID NO: 10862 - protein, 40 aa, Streptococcus agalactiae; identical to SEQ ID NO: 10854

SEQ ID NO: 10863 - DNA, 120 bp, Streptococcus agalactiae; identical to SEQ ID NO: 10853

SEQ ID NO: 10864 - protein, 40 aa, Streptococcus agalactiae; identical to SEQ ID NO: 10854

SEQ ID NO: 10865 - DNA, 120 bp, Streptococcus agalactiae; identical to SEQ ID NO: 10853

SEQ ID NO: 10866 - protein, 40 aa, Streptococcus agalactiae; identical to SEQ ID NO: 10854

SEQ ID NO: 10867 - DNA, 102 bp, Streptococcus agalactiae
gtgatttttctttacaaatttttatcaagcgtaagtattcattggtttcaagaaattttatctctatttacgccccttattttttgctttaaccttagtgaa

SEQ ID NO: 10868 - protein, 34 aa, Streptococcus agalactiae
MIFLYKFLSSVSIHWFQEILSLFTPLIFCFNLSE

SEQ ID NO: 10869 - DNA, 117 bp, Streptococcus agalactiae
gtgggtatgggtatcaaatatttttatcatatcatcgttctttctttgcttatcgtagctacaagcattaatctttattattataacataagactgaagcattctgatcagaaagag

SEQ ID NO: 10870 - protein, 39 aa, Streptococcus agalactiae
MGMGIKYFYHIIVLSLLIVATSINLYYYNIRLKHSDQKE

SEQ ID NO: 10871 - DNA, 381 bp, Streptococcus agalactiae
gtgctgtttcgaatggttccaaaacgcgatgatggtaagtcatcatggacagcgtgttttagagctgtgctgtttcgaatggttccaaaacttttacacacgatgtcagatataatgtcaagttttagagctgtgctgtttcgaatggttccaaaacagtactgcactaggaattgtagagatcaaagttttagagctgtgctgtttcgaatggttccaaaaccgtaccatctatcaatttaccgcaagctgtgttttagagctgtgctgtttcgaatggttccaaaacttaaaagatttaaactatcaagcgtcaattgttttagagctgtgctgtttcgaatggttccaaaacttctaaatgctggtgactgctttgca

SEQ ID NO: 10872 - protein, 127 aa, Streptococcus agalactiae
MLFRMVPKRDDGKSSWTACFRAVLFRMVPKLLHTMSDIMSSFRAVLFRMVPKQYCTRNCRDQSFRAVLFRMVPKPYHLSIYRKLCFRAVLFRMVPKLKRFKLSSVNCFRAVLFRMVPKLLNAGDCFA

SEQ ID NO: 10873 - DNA, 114 bp, Streptococcus agalactiae
ttgaaaaaaatagtttctatgagaatctttttcttgacaataaaatttagctattataaaatagttctcacgataactaaaataatgattttttcagaaaataatattatttct

SEQ ID NO: 10874 - protein, 38 aa, Streptococcus agalactiae
MKKIVSMRIFFLTIKFSYYKIVLTITKIMIFSENNIIS

SEQ ID NO: 10875 - DNA, 96 bp, Streptococcus agalactiae
ttggtgatagaatttccattttaccaattgctatcaaagtgctataataatagagttaaaattaagattgcttgccaatatgagccagcaggttat

SEQ ID NO: 10876 - protein, 32 aa, Streptococcus agalactiae
MVIEFPFYQLLSKCYNNRVKIKIACQYEPAGY

SEQ ID NO: 10877 - DNA, 102 bp, Streptococcus agalactiae
atgttatttggttcttttttgttgaggagacaaggagaggtcttgatacaggtggttaaaatgagaggagtatttattaaagtatgctatactattttagta

SEQ ID NO: 10878 - protein, 34 aa, Streptococcus agalactiae
MLFGSFLLRRQGEVLIQVVKMRGVFIKVCYTILV

SEQ ID NO: 10879 - DNA, 108 bp, Streptococcus agalactiae
gtgttattatttcaatctcaaactttattaaatagttcaaggataggagaatattatgaaagaaaagaaaaatttggggataaaattaataaaatccctatatggtat

SEQ ID NO: 10880 - protein, 36 aa, Streptococcus agalactiae
MLLFQSQTLLNSSRIGEYYERKEKFGDKINKIPIWY

SEQ ID NO: 10881 - DNA, 252 bp, Streptococcus agalactiae
atgattgtttgtgatttcactaactatattaactatatcatagctatttgcaaaaggaaaattggaaaaaattatataagtatagcttttactaatattattgtggaaataatcataaaggtcagattgatagacttgtgctatactattactaagaaaaaaggacagatattatggatattagacaacttacttactttattgctgttgcagaagcaaaaaattattcacgcgctgcaaaaagtctttttg

SEQ ID NO: 10882 - protein, 84 aa, Streptococcus agalactiae
MIVCDFTNYINYIIAICKRKIGKNYISIAFTNIIVEIIIKVRLIDLCYTITKKKGQILWILDNLLTLLLLQKQKIIHALQKVFL

SEQ ID NO: 10883 - DNA, 123 bp, Streptococcus agalactiae
atgaggataccttcatatttttcattccacttttcttctttaacttcaaaggaagaataccattccctaagtagctcaactatttctataactatccctcctttatcttcaaatcaatatgat

SEQ ID NO: 10884 - protein, 41 aa, Streptococcus agalactiae
MRIPSYFSFHFSSLTSKEEYHSLSSSTISITIPPLSSNQYD

SEQ ID NO: 10885 - DNA, 90 bp, Streptococcus agalactiae
ttggctatttttttcttagtaataagcgaagaagtcataatttctcctttattttatattgaattgctgatgatttattatggtttagtg

SEQ ID NO: 10886 - protein, 30 aa, Streptococcus agalactiae
MAIFFLVISEEVIISPLFYIELLMIYYGLV

SEQ ID NO: 10887 - DNA, 135 bp, Streptococcus agalactiae
atgctggtgactgctttgcataaagttttagagctgtgctgtttcgaatggttccaaaacttgctgctagacccaaacagtttatttttaggttttagagctgtgctgtttcgaatggttccaaaactccttttt

SEQ ID NO: 10888 - protein, 45 aa, Streptococcus agalactiae
MLVTALHKVLELCCFEWFQNLLLDPNSLFLGFRAVLFRMVPKLLF

SEQ ID NO: 10889 - DNA, 105 bp, Streptococcus agalactiae
atgtcatcagttatcatcactctttttatgatagttaagatttttaaactatcatcttttgaaaaacatttcatcttgactatttctgttaataaatcagctcca

SEQ ID NO: 10890 - protein, 35 aa, Streptococcus agalactiae
MSSVIITLFMIVKIFKLSSFEKHFILTISVNKSAP

SEQ ID NO: 10891 - DNA, 108 bp, Streptococcus agalactiae
ttgaagattaagaaaaacaaggttttaatattatattatcagcgagtaggagatggtgagagccctacaatccctaatattgaaattatcattttcaatcattctacc

SEQ ID NO: 10892 - protein, 36 aa, Streptococcus agalactiae
MKIKKNKVLILYYQRVGDGESPTIPNIEIIIFNHST

SEQ ID NO: 10893 - DNA, 102 bp, Streptococcus agalactiae
atgttagccaatcttaaggataataattccaataaaaaaaggctaaccaaagttagtctccctttatctactccgccagtaggactcgaacctacgacatca

SEQ ID NO: 10894 - protein, 34 aa, Streptococcus agalactiae
MLANLKDNNSNKKRLTKVSLPLSTPPVGLEPTTS

SEQ ID NO: 10895 - DNA, 108 bp, Streptococcus agalactiae
ttgataaataatatttttgacaacttttttcattataacaagaaaaaagtaggagaacaattacttaactggttaattagaaaatttgttattttatcattaataact

SEQ ID NO: 10896 - protein, 36 aa, Streptococcus agalactiae
MINNIFDNFFHYNKKKVGEQLLNWLIRKFVILSLIT

SEQ ID NO: 10897 - DNA, 108 bp, Streptococcus agalactiae
atggtgaaaactgtttcttatcccaaagatttatggtttccaaaatatccctcgctttgttactatccttgcaaacctgaaaaatttcgtcataaactgttgaaaaaa

SEQ ID NO: 10898 - protein, 36 aa, Streptococcus agalactiae
MVKTVSYPKDLWFPKYPSLCYYPCKPEKFRHKLLKK

SEQ ID NO: 10899 - DNA, 93 bp, Streptococcus agalactiae
atgactactttatcagaattgcaagaaaaagcaacatgtcaaatatgcttctacatggacttgatggcgaaaaatcaattttgttatcagcaa

SEQ ID NO: 10900 - protein, 31 aa, Streptococcus agalactiae
MTTLSELQEKATCQICFYMDLMAKNQFCYQQ

SEQ ID NO: 10901 - DNA, 147 bp, Streptococcus agalactiae
atgtctcctctctttaagagtgaaagaaaaataaaaaataatttgattatcaaattatcatgctttgtattttatcataaacctagctttcatggcaagataaaaaataaaaaaacggaattaaacttcccgtttttaatagttatc

SEQ ID NO: 10902 - protein, 49 aa, Streptococcus agalactiae
MSPLFKSERKIKNNLIIKLSCFVFYHKPSFHGKIKNKKTELNFPFLIVI

SEQ ID NO: 10903 - DNA, 102 bp, Streptococcus agalactiae
ttgaataccattgcaaattggattttatttctgagagtaggttataaaagatggtatgctcttattccggttctttcaggttttagaaaacatgagagaact

SEQ ID NO: 10904 - protein, 34 aa, Streptococcus agalactiae
MNTIANWILFLRVGYKRWYALIPVLSGFRKHERT

SEQ ID NO: 10905 - DNA, 147 bp, Streptococcus agalactiae
ttgggtttaacaactagcaataacactccgctgattgtatcactattttctttaaaagttattttgtctagtattatgtccggtgtagcttacaatggagttatgtatctaatatttaaaaacaatgttgatattgaaaaagatgaa

SEQ ID NO: 10906 - protein, 49 aa, Streptococcus agalactiae
MGLTTSNNTPLIVSLFSLKVILSSIMSGVAYNGVMYLIFKNNVDIEKDE

SEQ ID NO: 10907 - DNA, 177 bp, Streptococcus agalactiae
ttgctaagagcaattgtcaaaatttctcagtctatgctagaagagttcttcttaatcccaatatgtcatttgtcacgattaacacggattggaaataacatcaatcaaattgcgcgtgctatcaaccaaagccatctaatttctcaggctcagtatcactttcatcgagaagcacgt

SEQ ID NO: 10908 - protein, 59 aa, Streptococcus agalactiae
MLRAIVKISQSMLEEFFLIPICHLSRLTRIGNNINQIARAINQSHLISQAQYHFHREAR

SEQ ID NO: 10909 - DNA, 195 bp, Streptococcus agalactiae
gtgaatcgtcttagagaatacagaattaaagctagcatatctcaattagctttagcaaaatcagttggtgtcgccagacaaacaataaaccttattgaaaataataaatacaatccttcgctagatctttgtataagactagcggaatgcctacaaacagacctcaatactcttttttgggatagtagacatcta

SEQ ID NO: 10910 - protein, 65 aa, Streptococcus agalactiae
MNRLREYRIKASISQLALAKSVGVARQTINLIENNKYNPSLDLCIRLAECLQTDLNTLFWDSRHL

SEQ ID NO: 10911 - DNA, 201 bp, Streptococcus agalactiae
ttgtgtcgtgttttacgtgtcaatcgctccacttactataaatttctaaaacataagccctcaaaaagagaattggataatcaaatttatagaaaacaaatacttgagatttataccaaagcgaacaaaagacttggtgtgaagtctatcaaggtcattcttcaaagagactatgacacaaaaatctctgaaggaagaatt

SEQ ID NO: 10912 - protein, 67 aa, Streptococcus agalactiae
MCRVLRVNRSTYYKFLKHKPSKRELDNQIYRKQILEIYTKANKRLGVKSIKVILQRDYDTKISEGRI

SEQ ID NO: 10913 - DNA, 216 bp, Streptococcus agalactiae
atggcattgaccccgttggacactgcatttttcgccccatctattgcattggaaatagtggattttatggaattccaaatattgcttgctgttgaaagtatcccattaaaaattcctgaaatcgtgctactcaaattattaaacaaatttgacccagttgagaccagtccagaccacaaattggaaagagtggaagtgaaacttgaccacagagac

SEQ ID NO: 10914 - protein, 72 aa, Streptococcus agalactiae
MALTPLDTAFFAPSIALEIVDFMEFQILLAVESIPLKIPEIVLLKLLNKFDPVETSPDHKLERVEVKLDHRD

SEQ ID NO: 10915 - DNA, 240 bp, Streptococcus agalactiae
ttggagttaatagtgagtaaaaaagataagaaaattgaaattcaaatttcagacgctcaagtaacagttaatggaactaaggttgatggataccaactcgttattggaaaaaaaattgtaggtcaaattgcagagctagattctaaatttgctgtgattaaaggtgagcaagtgagtggattctataaaaatttagatcaagctatgggaaatattattgaagaatataatcttaatcgc

SEQ ID NO: 10916 - protein, 80 aa, Streptococcus agalactiae
MELIVSKKDKKIEIQISDAQVTVNGTKVDGYQLVIGKKIVGQIAELDSKFAVIKGEQVSGFYKNLDQAMGNIIEEYNLNR

SEQ ID NO: 10917 - DNA, 303 bp, Streptococcus agalactiae
ttgttggaattatgttataatcttagtaattacagatatgacgcagaaaggaaaaaattattgaataaacaagagcgtttaggaatgagcgtttatctttactataatcgtgacgctcgtaaattatataaatacggagatgttcattatcattctcgtagattaagatatctagtcatttatgttaataaagaggatattgttagcgttagtaaagagataaaacatttaaaatttgttaaggatgttcggttatcagcaattgatgatattgatcaggattttgttggaaacttatatcgt

SEQ ID NO: 10918 - protein, 101 aa, Streptococcus agalactiae
MLELCYNLSNYRYDAERKKLLNKQERLGMSVYLYYNRDARKLYKYGDVHYHSRRLRYLVIYVNKEDIVSVSKEIKHLKFVKDVRLSAIDDIDQDFVGNLYR

SEQ ID NO: 10919 - DNA, 354 bp, Streptococcus agalactiae
gtgaaaaagaacatcgaatctggtgttgctcatattcacgctacattcaataacactattgttatgattacagatgtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgta

SEQ ID NO: 10920 - protein, 118 aa, Streptococcus agalactiae
MKKNIESGVAHIHATFNNTIVMITDVHGNALAWSSAGALGFKGSRKSTPFAAQMAAEAAAKSAQEHGLKTVEVTVKGPGSGRESAIRALAAAGLEVTAIRDVTPVPHNGARPPKRRRV

SEQ ID NO: 10921 - DNA, 408 bp, Streptococcus agalactiae
ttgccttaccaaagagctgcaagcctatatattcgcttttctgttttcgttatcgaaagaaatataaaaatggaagaagaattcgatgataatgacgagcaagatactatttatgctgttctttatgatgggaaacagccagtttcaacaggacgctttcttcctgaaactcaaacagaagctcgtttgactcgaattgcgactttaaaaggttatcgtggtaacggctatggtaccaaaattattatagcactagaaaattatgcaaaagaaaatggttatcactatctaactatacatgctgaattgacagcaaaagatttctaccagacacttgggtatcaagctactgggaatatttatatggaagacggggaagcctgtcaaacactcgaaaaatatttaatt

SEQ ID NO: 10922 - protein, 136 aa, Streptococcus agalactiae
MPYQRAASLYIRFSVFVIERNIKMEEEFDDNDEQDTIYAVLYDGKQPVSTGRFLPETQTEARLTRIATLKGYRGNGYGTKIIIALENYAKENGYHYLTIHAELTAKDFYQTLGYQATGNIYMEDGEACQTLEKYLI

SEQ ID NO: 10923 - DNA, 501 bp, Streptococcus agalactiae
ttgaaattaaataaaataatattatctactgcagctcttactgctctctttttaggatataatagcgttactgcggatacatataataactatcagccacatagatcaaataatatggatttaactgaggaatataactataataaccagatagaacttcaggagcgtataaaaaaactaaatataccttttaaagaaaaacttgccttacttagaaaggttaaatcaagacaagattcttatgtattagacacattaagaaaagaagttgaaaataaaaacagtgagtattcagaactagagcaagaatatcaaagaatttcagctcttattgatgctaagtttccgcaagggaaatctagtttagcagaaaaattacataaagaactaatttgggacttggatggtgttaaatatgatgagggtatttctaagagaactgctctaaaaaaattagaaggtaaaatcaacgaatatactaaaaaatacagttatttattc

SEQ ID NO: 10924 - protein, 167 aa, Streptococcus agalactiae
MKLNKIILSTAALTALFLGYNSVTADTYNNYQPHRSNNMDLTEEYNYNNQIELQERIKKLNIPFKEKLALLRKVKSRQDSYVLDTLRKEVENKNSEYSELEQEYQRISALIDAKFPQGKSSLAEKLHKELIWDLDGVKYDEGISKRTALKKLEGKINEYTKKYSYLF

SEQ ID NO: 10925 - DNA, 495 bp, Streptococcus agalactiae
ttgataaccttaaaatctcaacctcaagcttacaaatcagaagttgactgtaaacttttagaggcttttataaaaactaaagcttatcaaaatagttgtgtaattgctacttacctatcttttgactacgaatacaatacacaacttcttattaaacaagctttatgtgatggcaaacgtgtccttgttcccaaaacttatccaaaaggtaaaatgatttttgtggactatcaaaaagataacttgaggacaacaccgtttggcttattagaacctgttaatgatagagctgttgaaaaagctagtatagacttaattcatgtgcccggacttatctttaacaataaaggttttcgtataggttatggtgcaggttattttgatcgctatttgagtgattttgaaggtgatactattagtactatttataggtgtcagagacaggattttgtagaagagaagcatgacgtagcagttaaggaggtattatgtcta

SEQ ID NO: 10926 - protein, 165 aa, Streptococcus agalactiae
MITLKSQPQAYKSEVDCKLLEAFIKTKAYQNSCVIATYLSFDYEYNTQLLIKQALCDGKRVLVPKTYPKGKMIFVDYQKDNLRTTPFGLLEPVNDRAVEKASIDLIHVPGLIFNNKGFRIGYGAGYFDRYLSDFEGDTISTIYRCQRQDFVEEKHDVAVKEVLCL

SEQ ID NO: 10927 - DNA, 507 bp, Streptococcus agalactiae
ttgatagacaaacagtctattggtaaaggtggtgtcggcgacattccagtagtgaaaacacatattgtaaaagtattactcgaccagattgaccaacctcaaccagaagtgccacggtttgtggctgattggtacgagaagcataaagatagcttagagtgcgatttatatttatatcacatgtcgatatacgatgaagaagtcgaaaaagatgacttctattactggatgcaaacatcaaaaaatccagtctacacacttattaatatgcaccaattcggctacaccatccaaaaagagaagctgtatacggttgagatacctaatccgaatgaaagacagttaagttttgtgctgatgagacaacttagcggaaatgtaagtatcaaagttatgcatagagataacttagacttactaaagacagataatgatttacaactaacagaatccgaaatccgcaaagatttcgactgggcgtggcagtttagagaagaggtggtggaa

SEQ ID NO: 10928 - protein, 169 aa, Streptococcus agalactiae
MIDKQSIGKGGVGDIPVVKTHIVKVLLDQIDQPQPEVPRFVADWYEKHKDSLECDLYLYHMSIYDEEVEKDDFYYWMQTSKNPVYTLINMHQFGYTIQKEKLYTVEIPNPNERQLSFVLMRQLSGNVSIKVMHRDNLDLLKTDNDLQLTESEIRKDFDWAWQFREEVVE

SEQ ID NO: 10929 - DNA, 468 bp, Streptococcus agalactiae
ttgtgtgttgtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 10930 - protein, 156 aa, Streptococcus agalactiae
MCVVLRYAFAPLPNIQPITAIFLITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 10931 - DNA, 474 bp, Streptococcus agalactiae
gtgaatttaccgtctactgaaccacctttgatttcaagagcttctgcatctttagcgaaatcgctaataactttagctggtgcaataacatcttcgttagaaaacgcaactgctgatggaccaacaaaaagttctttaaggtcttcaagacctgctttttcagctgcacgagttaaaattgagtttttgataactttaaactcaacatcgctttcacgaagtgaacgacgtaagttagtatcttgctcaacagtaagaccacgtgaatcaacaacaacgatacttgctgctgctttcattttctcagcaataagttcaacttgttcagctttttttgcaataattgcttcactcattagttttacctccgtttttattttttgggataagcacaaaaaaatcgcacctaaacctagacacgaaagtacaatacgttattttataatgacgttttgtgcctcggtaggaatatta

SEQ ID NO: 10932 - protein, 158 aa, Streptococcus agalactiae
MNLPSTEPPLISRASASLAKSLITLAGAITSSLENATADGPTKSSLRSSRPAFSAARVKIEFLITLNSTSLSRSERRKLVSCSTVRPRESTTTILAAAFIFSAISSTCSAFFAIIASLISFTSVFIFWDKHKKIAPKPRHESTIRYFIMTFCASVGIL

SEQ ID NO: 10933 - DNA, 603 bp, Streptococcus agalactiae
gtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaaggg

SEQ ID NO: 10934 - protein, 201 aa, Streptococcus agalactiae
MARDPYSDRSRYLDPKVLSSSFGAFFPADNIKVAWSNNSSTLFTPPINANYTTQIQAIGTTIKSQIPESILTVTDKKSRKFSINKIDEAKEGLVGATFTLSKRTTVAADHQVQGDFIPVSKETTVGRTTLTFDNLKPGFYDLKETKAPNAYVLDPKTYVVVVQNSGKTTIVDEANFKEADYPMADNTSHVECVALLQRSKG

SEQ ID NO: 10935 - DNA, 576 bp, Streptococcus agalactiae
gtgcaatcgaatagacaccgtggactaattgagaagccttatcatatcactttaattgagccaagcgatgaagaaatttatcgcttttctgctcttttgaaccgtgaaaagttttggttggaaaatgaacaggaaccaactattaggctttggtgttataaggttgatagctttgagattggaaaagacgaatttggtgcctgggtggtcgatgttaccttcatctgccaccctaccaagtttttcaagaccactgacatccagacattgactggtaatggggttttgagggttcaagggtcagctcttgcttttccgaagattacagtggttggtcagagcgcttctgagacatcgtttacgataggtaaccaagtgattaagcttgaaaagctctcagaatcgctcgtgatgaccaatgatcctgacaatcctagctttaagacggctagtggaaaactcattaagtgggctggtgattttatcacagttgatactgctaaggggcagaatgtcggtgttgttttaggtgctggcataacatctttgaaatttgaaacagtttgggggtgggca

SEQ ID NO: 10936 - protein, 192 aa, Streptococcus agalactiae
MQSNRHRGLIEKPYHITLIEPSDEEIYRFSALLNREKFWLENEQEPTIRLWCYKVDSFEIGKDEFGAWVVDVTFICHPTKFFKTTDIQTLTGNGVLRVQGSALAFPKITVVGQSASETSFTIGNQVIKLEKLSESLVMTNDPDNPSFKTASGKLIKWAGDFITVDTAKGQNVGVVLGAGITSLKFETVWGWA

SEQ ID NO: 10937 - DNA, 762 bp, Streptococcus agalactiae; identical to SEQ ID NO: 10777

SEQ ID NO: 10938 - protein, 254 aa, Streptococcus agalactiae; identical to SEQ ID NO: 10778

SEQ ID NO: 10939 - DNA, 681 bp, Streptococcus agalactiae
gtgagtccagattatgctccctttgagtttaaagcgcttgttaatgggaaagataaagttgtcggcgcagatattgagttagctcaagctattgctgatgagcttcatgtcaaactagaggtatctcctatgagttttgacaatgttttatcaagtttacaaacaggtaaggctgatatggctatttctggattatcatatactaaagagcgtgctaaagtctatgatttttcaaaaccttattacactacagaaaatgcggttcttgttaggaagtctgatttaggaaaatatacttcaatcgaaagccttaaaggtaaaaaaatagcagtacaaaaaggaagtatcgaagagggagtttctaagaaatcattcaaaaattctcacgtcgtgtcactgacagcgatgggagaagcgattagtgagttaaaatcaggcaaggtagaagctgttgatttagaaaaaaccgtagctgaaggttacttggcccagaatccagaccttgttcttgctaagtttgcccttaaaacaggagaaggggatgctaaggctgtagctttacctaaagacagtggaaaaatgttgaagactgttaacaaagtgataaagagacttgaaaaagaagataaatataaagtttatatttcagatgcggctaaattaactggcaatcaagttgaa

SEQ ID NO: 10940 - protein, 227 aa, Streptococcus agalactiae
MSPDYAPFEFKALVNGKDKVVGADIELAQAIADELHVKLEVSPMSFDNVLSSLQTGKADMAISGLSYTKERAKVYDFSKPYYTTENAVLVRKSDLGKYTSIESLKGKKIAVQKGSIEEGVSKKSFKNSHVVSLTAMGEAISELKSGKVEAVDLEKTVAEGYLAQNPDLVLAKFALKTGEGDAKAVALPKDSGKMLKTVNKVIKRLEKEDKYKVYISDAAKLTGNQVE

SEQ ID NO: 10941 - DNA, 690 bp, Streptococcus agalactiae
gtgtgtcaaaacattgcatggcctaaactgagtgctcaaacgaaaattataattgattatttttctactttaactgtttcagacttagaggatatctacagaattaatacaagtgcagctcgttgtgaggctcaaagatggcaagattttaaagctaaacaacttactctgaatcctgctattaagttattcaacggtcttatgtaccgcaatatcaaaaggcacaacttatccacaagtgaagcacaatttatggaaaattctgtttttattactagtgctctttatggcatcattcctgctatgacactaatatcccctcatcgtttagattttaacactaaaatcaaaatcaacaataactctcttaaagttttttggcgtgaaaattacgatacttttatgcagtcagatgacattatggtttctttgctttctaatgaatttgaaactgtcttttctcctaaagagcgtcaaaaactaatacatcttaactttattgaagatcgagatggccaattaaaaacccactctaccatatcaaaaaaagcaagaggaaagtgtttaactgctatgatggaaaataattgccaaactctagaacacttaaagcaattacgctttgatggcttctgttatgataatgaactctcagactctaagcaattaacttttgttaaaaaacagact

SEQ ID NO: 10942 - protein, 230 aa, Streptococcus agalactiae
MCQNIAWPKLSAQTKIIIDYFSTLTVSDLEDIYRINTSAARCEAQRWQDFKAKQLTLNPAIKLFNGLMYRNIKRHNLSTSEAQFMENSVFITSALYGIIPAMTLISPHRLDFNTKIKINNNSLKVFWRENYDTFMQSDDIMVSLLSNEFETVFSPKERQKLIHLNFIEDRDGQLKTHSTISKKARGKCLTAMMENNCQTLEHLKQLRFDGFCYDNELSDSKQLTFVKKQT

SEQ ID NO: 10943 - DNA, 954 bp, Streptococcus agalactiae
ttggtagaacgtacacttcgtccgcagtatttaagagagtatattggacaagataaggttaaagatcagctaaaaatatttattgaagctgctaaattgcgtgatgagtcattggatcatgtgttattatttggccctcctggtttagggaaaacaaccatggcatttgtaattgctaatgagttgggtgtcaatctcaaacaaacatcaggtcccgcaattgaaaaatcaggggatttagtagccattttaaatgatttagaaccaggtgatgttctttttattgatgaaattcatcgtatgccgatggcggttgaagaggtactttatagtgcaatggaagacttctatattgacattatgatcggtgcaggagaaactagtagaagtgttcatctagatttgccgccctttaccttaattggtgcaacgacacgtgcaggtatgttatctaatcccttacgtgctcgctttggtattacagggcatatggagtattatgaagaaaatgatttgacagaaattattgagcgtacagcagacatttttgaaatgaaaattacttatgaagctgcttctgaattagcgcgtcgcagtcgtggaacgccacgtatcgctaaccgtttattgaaacgtgttcgagattatgctcaaatcatgggagatggtttgatagatgacaatattacagataaagcattaacgatgttagatgttgatcacgaggggcttgattacgtcgatcaaaaaatcttaagaaccatgattgaaatgtataatggaggtcctgttggtttaggaactctatccgttaatattgctgaagaacgagatactgttgaagacatgtacgaaccttatttaattcaaaaaggttttattatgcgtacccgtaccggtcgtgtagctacggttaaggcatatgaacatttaggttatcagcgatttgataaa

SEQ ID NO: 10944 - protein, 318 aa, Streptococcus agalactiae
MVERTLRPQYLREYIGQDKVKDQLKIFIEAAKLRDESLDHVLLFGPPGLGKTTMAFVIANELGVNLKQTSGPAIEKSGDLVAILNDLEPGDVLFIDEIHRMPMAVEEVLYSAMEDFYIDIMIGAGETSRSVHLDLPPFTLIGATTRAGMLSNPLRARFGITGHMEYYEENDLTEIIERTADIFEMKITYEAASELARRSRGTPRIANRLLKRVRDYAQIMGDGLIDDNITDKALTMLDVDHEGLDYVDQKILRTMIEMYNGGPVGLGTLSVNIAEERDTVEDMYEPYLIQKGFIMRTRTGRVATVKAYEHLGYQRFDK

SEQ ID NO: 10945 - DNA, 1233 bp, Streptococcus agalactiae
ttgaaaaaaattattacttctattctattacttagttgcattttttttatgccaaccatctctgctgaatcttttaatgcttccgctaaacatgccttggcagttgatttagattcaggaaaaatcttgtatgaaaaagatgctaacaaacccgctgctattgcttccttgactaaaataatgaccgtttatatggtctataaagaaattgataacggtaacctcaagtggaataccaaagtaaatatatctgactacccttatcaactaacacgcgaatctgatgctagtaatgttcctttagaaaaaaggcgctatactgttaaacagctcgtggacgctgccatgatttctagtgctaacagtgcagccattgctttggctgaacatatttcaggaaccgaaagtaaatttgttgataaaatgactgctcaattggaaaagtggggaattcatgatagccacctagtcaatgcttctggcttaaataatagtatgttaggcaatcacatttatccaaaatcgtcacaaaacgacgaaaataaaatgagtgcacgtgatattgctattgttgcctaccatttggtcaacgaatatccttccattcttaagattactagtaagtccgttgctaaatttgataaagatattatgcattcttataactacatgctaccagatatgcctgtctttagaccaggtattacaggtttgaaaactgggacaacggaattagctggccaatcttttattgctacatctactgaaagtggaatgagactactcactgttattatgcatgctgataaggccgataaagacaaatatgctcgctttacagcaactaactctctcttgaactatatcacaaacacctacgaacctaaccttgtattagctaaaggagctgcatataaaggtaaagaagcaagtgtgagagacggaaaagaacaatcggtcatcgctgttgctaaaaacgatttgaaagtagtacagaagaaaaatatcactaaacaaaatcagttaaaaattaactttaaaaaagagcttactgctcctattacaaaaaaagagaacctagggaaagcttattacgttgaccttaataaggttggaaaaggctatctcataaaggaacctagcgttcatttagtggcaaaagatagtattgagcgcagtttcttcctcaaagtgtggtggaatcattttgtgcgctacgttaacgaaaaactt

SEQ ID NO: 10946 - protein, 411 aa, Streptococcus agalactiae
MKKIITSILLLSCIFFMPTISAESFNASAKHALAVDLDSGKILYEKDANKPAAIASLTKIMTVYMVYKEIDNGNLKWNTKVNISDYPYQLTRESDASNVPLEKRRYTVKQLVDAAMISSANSAAIALAEHISGTESKFVDKMTAQLEKWGIHDSHLVNASGLNNSMLGNHIYPKSSQNDENKMSARDIAIVAYHLVNEYPSILKITSKSVAKFDKDIMHSYNYMLPDMPVFRPGITGLKTGTTELAGQSFIATSTESGMRLLTVIMHADKADKDKYARFTATNSLLNYITNTYEPNLVLAKGAAYKGKEASVRDGKEQSVIAVAKNDLKVVQKKNITKQNQLKINFKKELTAPITKKENLGKAYYVDLNKVGKGYLIKEPSVHLVAKDSIERSFFLKVWWNHFVRYVNEKL

SEQ ID NO: 10947 - DNA, 1041 bp, Streptococcus agalactiae; identical to SEQ ID NO: 8531

SEQ ID NO: 10948 - protein, 347 aa, Streptococcus agalactiae
MNRKIIGLTLLSLSVLTLTACGNRSDKSANKSDIKVAMVTNQGGVDDKSFNQSAWEGLQKWGKKKGLTKGNGFDYFQSSNESDHANNLDTAASSGYNLIFGIGFGLHDTIEKVSENNKDVKYVIVDDIIKGKENVASVTFADNEAAYLAGVAAAKTTKTKTVGFIGGMEGVVVKRFEAGFKAGVKSIDPAIKVAVSYAGSFTDAAKGKTIAATQYATGVDVIYQAAGGTGAGIFSEAKTENETRKESNKVWVIGVDRDQSQEGNYVSKDGKKANFVLASTIKEVGKSLQSVAELTEKKQYPGGKVTVFGLKDSGVDIKEHQLSSEGSVAVKKAKEDIVSGKIQVPMK

SEQ ID NO: 10949 - DNA, 909 bp, Streptococcus agalactiae
ttgacagcgacagctgaatctattgaacaagtaaagcaattgctagcaataggaattgaccgcatctatgtaggggaagaaaattacggtcttcgtttaccacattcattttcagacgatgaattgcgtgaaatcgctaaattagtacatgatgctggtaaagaattgacagtagcttgtaatgcactcatgcatcaagagatgatggataatatcaaaccatttttggagttgatgaaagaaattaatgtggattatttggtagttggtgatgcaggagtattttatatcaacaagcgtgatggttataacttcaaacttatctacgacacttctgtcttcgttacatcaagtcgtcaagttaatttttggggacaacatggagcagtagaaacggttttagcacgtgaaataccttctgaagaactttttaagatgtctgagaatcttgaatttcctgctgagattttagtttatggggcttctgtaattcatcactctaagcgtccgttattgcaaaactattataattttactcatatcactgatgaaaaaacacgtgagcgtggtctttttttagcagaaccaggtgatccagaaagtcactattctatttacgaagataagcatgggactcatatttttattaacaatgatatcaatatgatgactaaagtgactgaactagttgaacatcactttactcactggaaattagatggtatttattgtccaggagataattttgttgctattgctgaaatttttgtcgaaacagctcgtttgattgaaaatggaacattcactcaggatcaggctttcttgtttgatgaacgaattagaaaactgcaccctaaaggacgtggtttagatactggattttatgattttgacccatcaacagtaaaa

SEQ ID NO: 10950 - protein, 303 aa, Streptococcus agalactiae
MTATAESIEQVKQLLAIGIDRIYVGEENYGLRLPHSFSDDELREIAKLVHDAGKELTVACNALMHQEMMDNIKPFLELMKEINVDYLVVGDAGVFYINKRDGYNFKLIYDTSVFVTSSRQVNFWGQHGAVETVLAREIPSEELFKMSENLEFPAEILVYGASVIHHSKRPLLQNYYNFTHITDEKTRERGLFLAEPGDPESHYSIYEDKHGTHIFINNDINMMTKVTELVEHHFTHWKLDGIYCPGDNFVAIAEIFVETARLIENGTFTQDQAFLFDERIRKLHPKGRGLDTGFYDFDPSTVK

SEQ ID NO: 10951 - DNA, 927 bp, Streptococcus agalactiae; identical to SEQ ID NO: 10781

SEQ ID NO: 10952 - protein, 309 aa, Streptococcus agalactiae; identical to SEQ ID NO: 10782

SEQ ID NO: 10953 - DNA, 1434 bp, Streptococcus agalactiae
gtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaatta

SEQ ID NO: 10954 - protein, 478 aa, Streptococcus agalactiae
MRYAPSPTGLLHIGNARTALFNYLYARHHGGDFVIRIEDTDRKRHVEDGERSQLENLRWLGMDWDESPETHENYRQSERLELYQRYIDQLLAEGKAYKSYVTEEELAAERERQELAGETPRYINEFIGMSETEKEAYIAEREAAGIIPTVRLAVNESGIYKWTDMVKGDIEFEGSNIGGDWVIQKKDGYPTYNFAVVIDDHDMQISHVIRGDDHIANTPKQLMVYEALGWEAPQFGHMTLIINSETGKKLSKRDTNTLQFIEDYRKKGYMSEAVFNFIALLGWNPGGEEEIFSREQLINLFDENRLSKSPAAFDQKKMDWMSNDYLKNADFESVFALCKPFLEEAGRLTDKAEKLVELYQPQLKSADEIVPLTDLFFADFPELTEAEKEVMAAETVPTVLSAFKEKLVSLSDEEFTRDTIFPQIKAVQKETGIKGKNLFMPIRIAVSGEMHGPELPDTIYLLGKEKSVQHIDNMLAKL

SEQ ID NO: 10955 - DNA, 1830 bp, Streptococcus agalactiae; identical to SEQ ID NO: 10775

SEQ ID NO: 10956 - protein, 610 aa, Streptococcus agalactiae; identical to SEQ ID NO: 10776

SEQ ID NO: 10957 - DNA, 1371 bp, Streptococcus agalactiae; identical to SEQ ID NO: 10779

SEQ ID NO: 10958 - protein, 457 aa, Streptococcus agalactiae; identical to SEQ ID NO: 10780

SEQ ID NO: 10959 - DNA, 2724 bp, Streptococcus agalactiae
gtggttgagcaagctcaatcgcttggcttacctgtaaaaagtcatgcttctagcgttgaagaaaatgatgctacacgtattgttgagagttttagctcttctaaaactaaagctccaacaaattctgttcaaactaatcaaggtgtgaaaacagaatctaaaactgttgaaaccaaacaaggcttgtccgatgataaaccttcaactcaacctgtagctaaaccgaaaccacaaagtcgtaactttaaggcggagcgcgaggctcgtgctaaagctgaagcggagaagcgtcaacataatggggatcaccgtaagaataatcgccataatgatacacgctctgacgacagacgccatcaaggtcaaaagcgttcaaatggtaatcgtaatgataaccgacaaggtcagcaaaataaccgtaataaaaatgatgggcgttatgctgatcataaacagaaaccccaaacgcgtcctcagcaacctgcaggcaatcgcattgactttaaagctcgagcagcagctttgaaagctgagcaaaatgctgaatactcacgtcatagtgagcagcgtttccgtgaagagcaagaagccaaacgtcaagcagctaaggagcaagaactagctaaagcagcagcgttaaaagcgcaagaagaagctcaaaaagctaaggaaaaacttgcttctaaacctgttgctaaggtaaaagaaattgtcaataaagtagccgctacgccatcacagacagcagatagtcgtcgtaaaaaacaaactcgttctgataagtctcgtcaattttcaaatgaaaatgaagatggacaaaagcaaacaagaaataagaaaaactggaataatcaaaaccaagtgagaaatcaaagaaatagtaactggaatcataataagaaaaataaaaaaggtaagactaatggagctccaaaaccagtaacagagcgtaaattccatgaattaccaaaagaatttgaatatactgagggcatgaccgttgcggaaattgcaaaacgtattaaacgcgaaccagcggaaattgttaaaaaactctttatgatgggagttatggcaacgcagaatcaatcattagatggagacactattgagctattgatggttgactacgggattgaagcacatgctaaggttgaagttgatgaagctgatattgaacgcttctttgcagatgaggattaccttaatcctgataacttaacggaacgtccgcctgttgttactatcatgggacacgttgatcatggtaaaacaactcttcttgatactctacgtaattcacgtgtcgctactggcgaagctggtggaattactcaacatattggtgcttatcagattgaagaagctggcaagaaaattactttcttggatacaccagggcatgcggcctttacttctatgcgtgcgcgtggtgcatcagtaactgatattactatccttatcgttgccgctgatgatggtgttatgccgcagacagttgaggcaattaatcactctaaagctgcgggtgtcccaattattgttgctatcaacaaaattgataaacctggtgcaaatccagaacgcgttatcagtgaattagctgagcatggtgtcatctctactgcatggggtggtgagtctgaatttgttgaaatttcagctaagtttggtaaaaatattcaagaattacttgagacagttcttttagttgctgaaatggaagaattaaaagcagatgcagatgttcgtgctattggtactgttattgaagcccgtcttgataaaggtaagggagccgttgcaacgcttcttgtccaacaaggtactttaaatgtacaagatccaatcgttgttggtaatacatttggacgtgttcgtgcgatgactaatgatcttgggcgtcgtgtcaaagttgcgggtccatctacaccagtttctattactggtttgaacgaagctccaatggctggtgatcattttgctgtttatgcagatgagaaagctgcgcgtgctgcaggtgaagaacgtgcaaaacgtgctctcttaaaacaacgccaaaacacgcaacgtgttagcctcgagaacttatttgatacccttaaagctggtgaagttaagtcagttaatgttattatcaaagctgatgtgcaaggttctgtagaagcacttgcagcttctctccttaagattgatgttgaaggagtaaaagttaacgttgttcactcagcagttggtgctattaatgagtctgatgtaacacttgctgaagcatcaaatgctgttattataggatttaacgtacgccctactccacaagctcgtcaacaagcagatgctgatgatgtcgaaattcgtcaacatagcattatctataaagttatcgaagaagttgaagaagcgatgaaaggtaaacttgatcctgaataccaagaaaaaatccttggtgaagccattattcgtgagacctttaaagtttcaaaagtgggaactattggtggatttatggttatcaatggtaaagttactcgtgattcaagtgttcgtgttatccgtgatggtgttgtcatttttgatggtaaattagcaagtcttaaacactataaagatgatgttaaagaagtcggcaatgctcaagaaggtggtctaatgattgagaattataacgatctcaaagaagatgacactattgaagcatacattatggaagaaattaaacgtaaa

SEQ ID NO: 10960 - protein, 908 aa, Streptococcus agalactiae
MVEQAQSLGLPVKSHASSVEENDATRIVESFSSSKTKAPTNSVQTNQGVKTESKTVETKQGLSDDKPSTQPVAKPKPQSRNFKAEREARAKAEAEKRQHNGDHRKNNRHNDTRSDDRRHQGQKRSNGNRNDNRQGQQNNRNKNDGRYADHKQKPQTRPQQPAGNRIDFKARAAALKAEQNAEYSRHSEQRFREEQEAKRQAAKEQELAKAAALKAQEEAQKAKEKLASKPVAKVKEIVNKVAATPSQTADSRRKKQTRSDKSRQFSNENEDGQKQTRNKKNWNNQNQVRNQRNSNWNHNKKNKKGKTNGAPKPVTERKFHELPKEFEYTEGMTVAEIAKRIKREPAEIVKKLFMMGVMATQNQSLDGDTIELLMVDYGIEAHAKVEVDEADIERFFADEDYLNPDNLTERPPVVTIMGHVDHGKTTLLDTLRNSRVATGEAGGITQHIGAYQIEEAGKKITFLDTPGHAAFTSMRARGASVTDITILIVAADDGVMPQTVEAINHSKAAGVPIIVAINKIDKPGANPERVISELAEHGVISTAWGGESEFVEISAKFGKNIQELLETVLLVAEMEELKADADVRAIGTVIEARLDKGKGAVATLLVQQGTLNVQDPIVVGNTFGRVRAMTNDLGRRVKVAGPSTPVSITGLNEAPMAGDHFAVYADEKAARAAGEERAKRALLKQRQNTQRVSLENLFDTLKAGEVKSVNVIIKADVQGSVEALAASLLKIDVEGVKVNVVHSAVGAINESDVTLAEASNAVIIGFNVRPTPQARQQADADDVEIRQHSIIYKVIEEVEEAMKGKLDPEYQEKILGEAIIRETFKVSKVGTIGGFMVINGKVTRDSSVRVIRDGVVIFDGKLASLKHYKDDVKEVGNAQEGGLMIENYNDLKEDDTIEAYIMEEIKRK

SEQ ID NO: 10961 - DNA, 2793 bp, Streptococcus agalactiae
ttgtcccacccgaaattagaaagtagtagcaataaagaaatcattaccgaagaggtcggtttactgaagcagcttttggatgaagcaacgcaaaaattgattggtagtgaatcatttgacaagattgaaaaaatagtttcattatcattaactgacgattatactggtctgaaggaaactatttcggctttaagcaacgaggagatggttattgtttctcgttacttctctattttgccgctcttaattaatatttcagaagacgttgatttagcatatgaaattaattataaaaataatcttaaccaagattacctaggaaagttatcaacgactattgatgttgtagctggccatgaaaatgctaaagatattcttgaacacgtcaatgttgtgcctgtgctaacagctcatcctactcaggtgcagcgtaaaacggtgctcgaattaacgtctaagattcatgatttattacgtaaatacagagatgtcaaggcaggaatcgtgaatcaagaaaaatggtatgctgacttgcgtcgttacatcggcattatcatgcaaacagacactattcgcgagaaaaaattgaaagtcaaaaatgagataaccaatgtaatggaatattacaaccgttctcttattaaagcagttaccaaattaacagcagaatataaggcactggcagctaaaaaaggtattcacttggagaatcctaagcctctgactatggggatgtggattggtggtgatagagatggcaatccctttgtaactgctgagacactaagattatcagctatggtacaaagtgaagtgattattaaccattatattgagcagctaaatgaactttatcgtaatatgtcactttcaataaatctaactgaagtctctcccgaacttgttacattggcaaaccagtcacaagataattcggtatatagggaaaatgaaccttaccgtaaagctttcaattttatccaagataaactggtacaaaccctactaaatttaaaagttggttcttccccaaaagagaaatttgttagtcgccaagaatcttctgatattgtaggaaggtatataaaatcacatatcgctcaagtagcttctgacatacagacagaagaactaccagcatacgctactgctgaggagtttaaacaagatttgttacttgtgaagcaatctttagttcaatatggacaagattctcttgttgatggcgaattagcttgtcttattcaagcagtagatatctttggattttatttagctactattgatatgcgtcaagattctagtattaatgaagcttgtgtagcagaattattgaagtctgccaatattgtagatgattacagttctctttcagaagaagaaaaatgtcaacttctcttaaaagaattaacagaagatcctagaacattatcttctacgcatgctcctaaatccgagttacttcaaaaagaattggctattttccaaacagcacgtgagttaaaagatcaattgggtgaagacattataaaccagcatatcatttctcacacagagagcgtttcggatatgtttgagttagctatcatgttaaaagaagttggactaattgatgccaatcaagctcgtattcagattgtaccgttatttgaaaccatcgaagatttggataattcacgtgatattatgacccagtatctacattatgaattagttaaaaaatggattgctactaacaacaattatcaagaaataatgctaggttattcagatagtaataaagatggtggctatttatcatctggttggactctatataaagctcaaaatgagctaacaaaaataggtgaagaaaacggtattaaaatcacatttttccacggtcgtggtggaactgttggtcgtggtggtggtccatcttatgaagctatcacatcacaaccttttggttcaatcaaagatcgaattcgcctaacagagcaaggtgaaatcattgagaataaatatggtaatcaagatgcagcctattataaccttgaaatgcttatttcagcttccatagaccgcatggtaacacgtatgattactaaccctaatgaaattgataatttccgtgagacaatggatggtattgtgtctgaaagtaatgccgtttatagaaatttagtttttgataatccttatttctatgactatttctttgaagcaagtccaattaaagaggtatcaagtttaaatattggttctcggccagcagcacgtaaaacaattacagaaatttcaggtttacgtgcaattccatgggtattttcatggtcacaaaatcgtattatgtttccaggatggtatggtgttggatcagccttcaagcactttattgaacaagatgaggcaaacttagcaaaattacaaaccatgtatcaaaaatggccattctttaattctcttttatctaatgtagatatggttttatcaaaatcaaatatgaatattgcgcttcagtatgctcagttagctggaagtaaagaagttcgagatgtttttaatatcatccttaatgaatggcagttaactaaagatatgattttagctattgaacagcatgataatttattagaagaaaacccaatgttacatgcaagtttagattatcgtttgccatatttcaatgttttgaattatgttcaaattgaattgattaaacgtcttcgtagtaaccaactagatgaagactatgagaagttgattcatattactattaatggtattgcaacaggtttacgaaattcaggt

SEQ ID NO: 10962 - protein, 931 aa, Streptococcus agalactiae
MSHPKLESSSNKEIITEEVGLLKQLLDEATQKLIGSESFDKIEKIVSLSLTDDYTGLKETISALSNEEMVIVSRYFSILPLLINISEDVDLAYEINYKNNLNQDYLGKLSTTIDVVAGHENAKDILEHVNVVPVLTAHPTQVQRKTVLELTSKIHDLLRKYRDVKAGIVNQEKWYADLRRYIGIIMQTDTIREKKLKVKNEITNVMEYYNRSLIKAVTKLTAEYKALAAKKGIHLENPKPLTMGMWIGGDRDGNPFVTAETLRLSAMVQSEVIINHYIEQLNELYRNMSLSINLTEVSPELVTLANQSQDNSVYRENEPYRKAFNFIQDKLVQTLLNLKVGSSPKEKFVSRQESSDIVGRYIKSHIAQVASDIQTEELPAYATAEEFKQDLLLVKQSLVQYGQDSLVDGELACLIQAVDIFGFYLATIDMRQDSSINEACVAELLKSANIVDDYSSLSEEEKCQLLLKELTEDPRTLSSTHAPKSELLQKELAIFQTARELKDQLGEDIINQHIISHTESVSDMFELAIMLKEVGLIDANQARIQIVPLFETIEDLDNSRDIMTQYLHYELVKKWIATNNNYQEIMLGYSDSNKDGGYLSSGWTLYKAQNELTKIGEENGIKITFFHGRGGTVGRGGGPSYEAITSQPFGSIKDRIRLTEQGEIIENKYGNQDAAYYNLEMLISASIDRMVTRMITNPNEIDNFRETMDGIVSESNAVYRNLVFDNPYFYDYFFEASPIKEVSSLNIGSRPAARKTITEISGLRAIPWVFSWSQNRIMFPGWYGVGSAFKHFIEQDEANLAKLQTMYQKWPFFNSLLSNVDMVLSKSNMNIALQYAQLAGSKEVRDVFNIILNEWQLTKDMILAIEQHDNLLEENPMLHASLDYRLPYFNVLNYVQIELIKRLRSNQLDEDYEKLIHITINGIATGLRNSG

SEQ ID NO: 10963 - DNA, 2553 bp, Streptococcus agalactiae
gtggctattgtttctaatagcttagagctaggtcttgccatttggatggttaatgtgattaatggtatttttagtttcattcaggaataccgtgcaagccaagcaacacaagctctcgagaaaatgttaccatcttattcacgtgttcttagaaaaggctcagaagaaaagatattatcagagcaactagtcccaggcgatattgttcttattgaagaaggagaccgtatttcagcagatggtcgcttgattaaaacaacagatttgcaagtaaaccaatcagccttgacaggggaatcaaatcctatttataaagatagcaatgttgaaaacgaccagtctaaaacattgattgaatgtgataatatggttttcgcaggaacgacggtctccagtggtagcgcaacaatggttgttacggcaattggaatgcaaactcaatttggtcaaatcgctgatttaacacaagggatgaaatcagaaaaaagccctcttcaaagagaacttgatcggttgaccaaacagatttctatcatttcaattacggtaggaattatctttttcttagcagcgactttttttgttaaggagccagtgtcaaaatcatttatctttgccttggggatgatcgttgcatttatcccagaaggtttactacctaccgttacactttctctagctatggcagtccaacgaatggctaaagaacacgcacttgtcaaaaaactttcttcagttgagactcttggagcaacctcagttatctgttctgataagactggtacattaacgcaaaatgaaatgaccgtcaatcatttgtggcaaaatggaaagagttaccaagtgacaggactgggttatgctccagaaggacagattctttttgaaggtgacaatatttgctttggtaatagtgatagaggagacttagaaaaacttattcgttttgctcatctctgtagcaacgctcaagtattaccaccaaatgatgatcgttcaacttatactgtacttggagatccgacagaagcttgtttgaatgttttattggaaaaatcagggataaacatacaagaaaatcgtaagtttgcaccacgtttgaaagaattaccttttgattcggttagaaaacgcatgacaactattcatagcttaggaggcgatgaaaaggataaaaaaatttcaattacaaaaggtgcgccgaaagaaatacttgatttatcagattatgtcttatctgatggcaaagttatccccttaaacaaggaagaacgtaataaaatacagttggctaacgatacatttgctaaagatggacttcgcgtcttagctgtttcatactgcgatattgaaggcttttcaaaagaacaatggacgcaagaaaatttggaacaacacatggtgtttatagggttgatagcaatgagtgatccacctcgtgaaggcgttcgcgaagctattgataaatgtcatgcagcaagcattcgtattattatggtgactggagattacggattaacggcactaagtatcgctaaaaatattggtattattcgtaacgatgatgctaaagtaatttcaggtttagagttatcagaaatgacggatagccaattgaaaaaagaattgtcaggtgaagtcgtttttgctcgtgtagcaccagaacaaaaatatcgagtagtaacgatattacaggagatgggtgaagtagtagcagttacaggagacggggtcaatgatgcgcctgcgctaaaaaaatccgatattggtgtagccatgggtgttaccggtactgatgttgctaaagaatcagctgatatgattctgacagatgatcattttgcttctattgtacatgctgtggaagaaggacgggctgtttatcaaaacattaagaaattcttgacgtatatttttaatagtaatactcctgaggctgttccgtcggcattcttccttttttctaaaggttttattcctttaccattgactgtaatgcaaatacttgctgttgatttgggaaccgatatgcttcccgctttaggtctgggcgtggaaccaccagaaacagacgttatgaatcgtcctccaagacggctaacagatcgcttattggacaaagggctacttataaaatctttcctttggtacggcactattgaatccgtattagctatgggtggttttttctgggctcattacttacgttatggtaattttacttttttcgtcgcaaacggcataccgtacagagaagcgacaactatgacacttggagctattatctttagccagataggtatggttatgaatagcagaacgagctatcaatctattaaagcactatctatttttggtaataaattaattaattttggtataataatggagattttagcatttttagtcttagtatacgtgccactattccataacttattcaacacagcaagcctaggtttatcacattggctctatttaataagctgcccatttatcatgataggtttagatgaagttcggaaattattcagcagtagaaagaataaacgg

SEQ ID NO: 10964 - protein, 851 aa, Streptococcus agalactiae
MAIVSNSLELGLAIWMVNVINGIFSFIQEYRASQATQALEKMLPSYSRVLRKGSEEKILSEQLVPGDIVLIEEGDRISADGRLIKTTDLQVNQSALTGESNPIYKDSNVENDQSKTLIECDNMVFAGTTVSSGSATMVVTAIGMQTQFGQIADLTQGMKSEKSPLQRELDRLTKQISIISITVGIIFFLAATFFVKEPVSKSFIFALGMIVAFIPEGLLPTVTLSLAMAVQRMAKEHALVKKLSSVETLGATSVICSDKTGTLTQNEMTVNHLWQNGKSYQVTGLGYAPEGQILFEGDNICFGNSDRGDLEKLIRFAHLCSNAQVLPPNDDRSTYTVLGDPTEACLNVLLEKSGINIQENRKFAPRLKELPFDSVRKRMTTIHSLGGDEKDKKISITKGAPKEILDLSDYVLSDGKVIPLNKEERNKIQLANDTFAKDGLRVLAVSYCDIEGFSKEQWTQENLEQHMVFIGLIAMSDPPREGVREAIDKCHAASIRIIMVTGDYGLTALSIAKNIGIIRNDDAKVISGLELSEMTDSQLKKELSGEVVFARVAPEQKYRVVTILQEMGEVVAVTGDGVNDAPALKKSDIGVAMGVTGTDVAKESADMILTDDHFASIVHAVEEGRAVYQNIKKFLTYIFNSNTPEAVPSAFFLFSKGFIPLPLTVMQILAVDLGTDMLPALGLGVEPPETDVMNRPPRRLTDRLLDKGLLIKSFLWYGTIESVLAMGGFFWAHYLRYGNFTFFVANGIPYREATTMTLGAIIFSQIGMVMNSRTSYQSIKALSIFGNKLINFGIIMEILAFLVLVYVPLFHNLFNTASLGLSHWLYLISCPFIMIGLDEVRKLFSSRKNKR

SEQ ID NO: 10965 - DNA, 4650 bp, Streptococcus agalactiae
ttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 10966 - protein, 1550 aa, Streptococcus agalactiae
MGTLFFLGGITNVAADSVINKPSDIAVEQQVKDSPTSIANETPTNNTSSALASTAQDNLVTKANNSPTETQPVAESHSQATETFSPVANQPVESTQEVSKTPLTKQNLAVKSTPAISKETPQNIDSNKIITVPKVWNTGYKGEGTVVAIIDSGLDINHDALQLNDSTKAKYQNEQQMNAAKAKAGINYGKWYNNKVIFGHNYVDVNTELKEVKSTSHGMHVTSIATANPSKKDTNELIYGVAPEAQVMFMRVFSDEKRGTGPALYVKAIEDAVKLGADSINLSLGGANGSLVNADDRLIKALEMARLAGVSVVIAAGNDGTFGSGASKPSALYPDYGLVGSPSTAREAISVASYNNTTLVNKVFNIIGLENNRNLNNGLAAYADPKVSDKTFEVGKQYDYVFVGKGNDNDYKDKTLNGKIALIERGDITFTKKVVNAINHGAVGAIIFNNKAGEANLTMSLDPEASAIPAIFTQKEFGDVLAKNNYKIVFNNIKNKQANPNAGVLSDFSSWGLTADGQLKPDLSAPGGSIYAAINDNEYDMMSGTSMASPHVAGATALVKQYLLKEHPELKKGDIERTVKYLLMSTAKAHLNKDTGAYTSPRQQGAGIIDVAAAVQTGLYLTGGENNYGSVTLGNIKDKISFDVTVHNINKVAKDLHYTTYLNTDQVKDGFVTLAPQQLGTFTGKTIRIEPGQTQTITIDIDVSKYHDMLKKVMPNGYFLEGYVRFTDPVDGGEVLSIPYVGFKGEFQNLEVLEKSIYKLVANKEKGFYFQPKQTNEVPGSEDYTALMTTSSEPIYSTDGTSPIQLKALGSYKSIDGKWILQLDQKGQPHLAISPNDDQNQDAVAVKGVFLRNFNNLRAKVYRADDVNLQKPLWVSAPQAGDKNYYSGNTENPKSTFLYDTEWKGTTTDGIPLEDGKYKYVLTYYSDVPGSKPQQMVFDITLDRQAPTLTTATYDKDRRIFKARPAVEHGESGIFREQVFYLKKDKDGHYNSVLRQQGEDGILVEDNKVFIKQEKDGSFILPKEVNDFSHVYYTVEDYAGNLVSAKLEDLINIGNKNGLVNVKVFSPELNSNVDIDFSYSVKDDKGNIIKKQHHGKDLNLLKLPFGTYTFDLFLYDEERANLISPKSVTVTISEKDSLKDVLFKVNLLKKAALLVEFDKLLPKGATVQLVTKTNTVVDLPKATYSPTDYGKNIPVGDYRLNVTLPSGYSTLENLDDLLVSVKEDQVNLTKLTLINKAPLINALAEQTDIITQPVFYNAGTHLKNNYLANLEKAQTLIKNRVEQTSIDNAIAALRESRQALNGKETDTSLLAKAILAETEIKGNYQFVNASPLSQSTYINQVQLAKNLLQKPNVTQSEVDKALENLDIAKNQLNGHETDYSGLHHMIIKANVLKQTSSKYQNASQFAKENYNNLIKKAELLLSNRQATQAQVEELLNQIKATEQELDGRDRVSSAENYSQSLNDNDSLNTTPINPPNQPQALIFKKGMTKESEVAQKRVLGVTSQTDNQKVKTNKLPKTGESTPKITYTILLFSLSMLGLATIKLKSIKRE
